United States Patent 11,931,406 (FLAVIVIRUS VACCINE) - sequence listing, part 47

SEQ ID NO: 17376 - RNA, 9876 nt, Artificial Sequence
  derived and/or modified CDS sequence (opt4) from DENV-2__EU687220__SS-prME
accgccggcgugaucaucaugcugauccccaccgccauggccuuccaccugaccaccagaaacggcgagccccacaugaucgugggcagacaggagaagggcaagagccugcuguucaagaccgaggacggcgugaacaugugcacccugauggccaucgaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgugcagagaaucgagaccuggauccugagacaccccggcuucgccaucauggccgccauccuggccuacaccaucggcaccacccacuuccagaaggcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaacgaggagcaggacaagagauucaucugcaagcacagcaugguggacagaggcuggggcaacggcugcggccuguucggcaagggcggcaucgugaccugcgccauguucaccugcaagaagaacauggagggcaagguggugcugcccgagaaccuggaguacaccaucgugaucaccccccacagcggcgaggagcacgccgugggcaacgacaccggcaagcacggcaaggagaucaagaucaccccccagagcagcaucaccgaggccgagcugaccggcuacggcaccgugaccauggagugcagccccagaaccggccuggacuucaacgagauggugcugcugcagauggaggagaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagaucgugaaggagaucgccgagacccagcacggcaccaucgugaucagagugcaguacgagggcgacggcagccccugcaagauccccuucgagaucauggaccuggagaagagacacgugcugggcagacugaucaccgugaaccccaucgugaccgagaaggacagccccaucaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcguggugacccuguaccugggcgccauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucagcaccaacaucuggcugaagcugagagagaagcaggacguguucugcgacagcaagcugaugagcgccgccaucaaggacaacagagccgugcacgccgacaugggcuacuggaucgagagcgcccugaacgacaccuggaagauggagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcaagcuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugauggccaccaucggcaucgcccugcugagccagagcaccauccccgagaccauccuggagcugaccgacgcccuggcccugggcaugauggugcugaagaucgugagaaacauggagaaguaccagcuggccgugaccaucauggccaucagcugcgugcccaacgccgugauccugcugaacgccuggaaggugagcugcaccauccuggccgccgugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccgugauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugaagugggaggaccacgccgagaucagcggcagcagccccauccugagcaucaccaucagcgaggacggcagcaugagcaucaagaacgaggaggaggagcagacccugaccauccugaucagaaccggccugcuggugaucagcggcguguuccccgugagcauccccaucaccgccgccgccugguaccugugggaggugaagaagcagagagccggcgugcugugggacgugcccagccccccccccgugggcaaggccgagcuggaggacggcgccuacagaaucaagcagagaggcauccugggcuacagccagaucggcgccggcguguacaaggagggcaccuuccacaccauguggcacgugaccagaggcgccgugcugaugcacagaggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucguggacagaaagggcaagguggugggccuguacggcaacggcguggugaccagaagcggcgccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagagccaacgacugggacuucguggugaccaccgacaucagcgagaugggcgccaacuucagagccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacagaguggccgccgagggcaucaacuacgccgacagaagauggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagagacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucaccacccaggagagcgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggagcccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccaucgaggccggcagaacccugagagugcugaaccugguggagaacuggcugaacaacaacacccaguucugcaucaaggugcugaaccccuacaugcccagcgugaucgagaagauggagacccugcagagaaaguacggcggcgcccuggugagaaacccccugagcagaaacagcacccacgagauguacugggugagcaacgccaccggcaacaucgugagcagcgugaacaugaucagcagaaugcugaucaacagauucaccaugaagcacaagaaggccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacguggugcccauggugacccagauggccaugaccgacaccacccccuucggccagcagagaguguucaaggagaagguggacaccagaacccaggagcccaaggagggcaccaagaagcugaugagaaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcagauucugggagcugguggacagagagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagaggcaacagccugagcggcguggagggcgagggccugcacagacugggcuacauccugagagacgugagcaagaaggagggcggcgccauguacgccgacgacaccgccggcugggacaccagaaucacccuggaggaccugaagaacgaggagauggugaccaaccacaugaagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcaucuucaagagcauccagcaccugaccgugaccgaggagaucgccgugcagaacuggcuggugagagugggcagagagagacugagcagaauggccaucagcggcgacgacugcguggugaagccccuggacgacagauucgccagcgcccugaccgcccugaacgacaugggcaaggugagaaaggacauccagcagugggagcccagcagaggcuggaacgacuggacccaggugcccuucugcagccaccacuuccacgagcuggugaugaaggacggcagagugcugguggugcccugcagaaaccaggacgagcugaucggcagagccagaaucagccagggcgccggcuggagccugaaggagaccgccugccugggcaagagcuacgcccagauguggacccugauguacuuccacagaagagaccugagacuggccgccaacgccaucugcagcgccgugcccagccacugggugcccaccagcagaaccaccuggagcauccacgccaagcacgaguggaugaccaccgaggacaugcuggccguguggaacagaguguggauccaggagaaccccuggauggaggacaagacccccguggagagcugggaggaggugcccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 17377 - RNA, 9876 nt, Artificial Sequence
  derived and/or modified CDS sequence (opt4) from DENV-2__EU726775__SS-prME
accgccggcgugaucgugaugcugauccccaccgccauggccuuccaccugaccaccagaaacggcgagccccacaugaucgugggcagacaggagaagggcaagagccugcuguucaagaccgaggacggcgugaacaugugcacccugauggccaucgaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgugcagagaaucgagaccuggauccugagacaccccggcuucaccaucauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaacgaggagcaggacaagagauucaucugcaagcacagcaugguggacagaggcuggggcaacggcugcggccuguucggcaagggcggcaucgugaccugcgccauguucaccugcaagaagaacauggagggcaagguggugcagcccgagaaccuggaguacaccaucgugaucaccccccacagcggcgaggagcacgccgugggcaacgacaccggcaagcacggcaaggagaucaagaucaccccccagagcagcaucaccgaggccgagcugaccggcuacggcaccgugaccauggagugcagccccagaaccggccuggacuucaacgagauggugcugcugcagauggaggacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagaucgugaaggagaucgccgagacccagcacggcaccaucgugaucagagugcaguacgagggcgacggcagccccugcaagauccccuucgagaucaccgaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcguggugacccuguaccugggcgccauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucaccaccaacaucuggcugaagcugagagagaagcaggacguguucugcgacagcaagcugaugagcgccgccaucaaggacaacagagccgugcacgccgacaugggcuacuggaucgagagcgcccugaacgacaccuggaagauggagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcaagcuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugauggccaccaucggcaucgcccugcugagccagagcaccauccccgagaccauccuggagcugaccgacgcccuggcccugggcaugauggugcugaagaucgugagaaacauggagaaguaccagcuggccgugaccaucauggccaucagcugcgugcccaacgccgugauccugcagaacgccuggaaggugagcugcaccauccuggccgccgugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggcguguuccccgugagcauccccaucaccgccgccgccugguaccugugggaggugaagaagcagagagccggcgugcugugggacgugcccagccccccccccgugggcaaggccgagcuggaggacggcgccuacagaaucaagcagagaggcauccugggcuacagccagaucggcgccggcguguacaaggagggcaccuuccacaccauguggcacgugaccagaggcgccgugcugaugcacagaggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggcaucuucagaaccaacaccggcaccaucggcgccaucagccuggacuucagccccggcaccagcggcagccccaucguggacagaaagggcaagguggugggccuguacggcaacggcguggugaccagaagcggcgccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucaaggccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagagccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaaaguggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagaaacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucaccacccaggagagcgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggagcccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccaucgaggccggcagaacccugagagugcugaaccugguggagaacuggcugaacaacaacacccaguucugcaucaaggugcugaaccccuacaugcccagcgugaucgagaagauggagacccugcagagaaaguacggcggcgcccuggugagaaacccccugagcagaaacagcacccacgagauguacugggugagcaacgccaccggcaacaucgugagcagcgugaacaugaucagcagaaugcugaucaacagauucaccaugaagcacaagaaggccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacguggugcccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacggcagauucugggagcugguggacagagagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagaggcaacagccugagcggcguggagggcgagggccugcacagacugggcuacauccugagagacgugggcaagaaggagggcggcgccauguacgccgacgacaccgccggcugggacaccagaaucacccuggaggaccugaagaacgaggagauggugaccaaccacaugaagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcaucuucagaagcauccagcaccugaccgccaccgaggagaucgccgugcagaacuggcuggccagagugggcagagagagacugagcagaauggccaucagcggcgacgacugcguggugaagcccaucgacgacagauucgccagcgcccugaccgcccugaacgacaugggcaaggugagaaaggacauccagcagugggagcccagcagaggcuggaacgacuggacccaggugcccuucugcagccaccacuuccacgagcuggugaugaaggacggcagagugcugguggugcccugcagaaaccaggacgagcugaucggcagagccagaaucagccagggcgccggcuggagccugaaggagaccgccugccugggcaagagcuacgcccagauguggacccugauguacuuccacagaagagaccugagacuggccgccaacgccaucugcagcgccgugcccagccacugggugcccaccagcagaaccaccuggagcauccacgccaagcacgaguggaugaccaccgaggacaugcuggccguguggaacagaguguggauccaggagaaccccuggauggaggacaagacccccguggagagcugggaggaggugcccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 17378 - RNA, 9876 nt, Artificial Sequence
  derived and/or modified CDS sequence (opt4) from DENV-2__FJ639732__SS-prME
accgccggcgugaucgugaugcugauccccaccgccauggccuuccaccugaccaccagaaacggcgagccccacaugaucgugggcagacaggagaagggcaagagccugcuguucaagaccgaggacggcgugaacaugugcacccugauggccaucgaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgugcagagaaucgagaccuggauccugagacaccccggcuucaccaucauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaacgaggagcaggacaagagauucaucugcaagcacagcaugguggacagaggcuggggcaacggcugcggccuguucggcaagggcggcaucgugaccugcgccauguucaccugcaagaagaacauggagggcaagguggugcagcccgagaaccuggaguacaccaucgugaucaccccccacagcggcgaggagcacgccgugggcaacgacaccggcaagcacggcaaggagaucaagaucaccccccagagcagcaucaccgaggccgagcugaccggcuacggcaccgugaccauggagugcagccccagaaccggccuggacuucaacgagauggugcugcugcagauggaggacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagaucgugaaggagaucgccgagacccagcacggcaccaucgugaucagagugcaguacgagggcgacggcagccccugcaagauccccuucgagaucaccgaccuggagaagagacacgugcugggcagacugaucaccgugaaccccaucgugaucgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcguggugaucaccuggaucggcaugaacagcagaagcaccagccugagcgugagccuggugcuggugggcguggugacccuguaccugggcgccauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaccaagggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucaccaccaacaucuggcugaagcugagagagaagcaggacguguucugcgacagcaagcugaugagcgccgccgugaaggacaacagagccgugcacgccgacaugggcuacuggaucgagagcgcccugaacgacaccuggaagauggagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcaagcuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugauggccaccaucggcaucacccugcugagccagagcaccauccccgagaccauccuggagcugaccgacgcccuggcccugggcaugauggugcugaagaucgugagaaacauggagaaguaccagcuggccgugaccaucauggccaucagcugcgugcccaacgccgugauccugagaaacgccuggaaggugagcugcaccauccuggccgccgugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggcguguuccccgugagcauccccaucaccgccgccgccugguaccugugggaggugaagaagcagagagccggcgugcugugggacgugcccagccccccccccgugggcaaggccgagcuggaggacggcgccuacagaaucaagcagagaggcauccugggcuacagccagaucggcgccggcguguacaaggagggcaccuuccacaccauguggcacgugaccagaggcgccgugcugaugcacagaggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggcaucuucaagaccaacaccggcaccaucggcgccgugagccuggacuucagccccggcaccagcggcagccccaucguggacagaaagggcaagguggugggccuguacggcaacggcguggugaccagaagcggcgccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucaaggccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagagccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaaaguggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagaaacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcgugcugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucaccacccaggagagcgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggagcccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccaucgaggccggcagaacccugagagugcugaaccugguggagaacuggcugaacaacaacacccaguucugcaucaaggugcugaaccccuacaugcccagcgugaucgagaagauggagacccugcagagaaaguacggcggcgcccuggugagaaacccccugagcagaaacagcacccacgagauguacugggugagcaacgccaccggcaacaucgugagcagcgugaacaugaucagcagaaugcugaucaacagauucaccaugaagcacaagaaggccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacguggugcccauggugacccagauggccaugaccgacaccacccccuucggccagcagagaguguucaaggagaagguggacaccagaacccaggagcccaaggagggcaccaagaagcugaugagaaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacggcagauucugggagcugguggacagagagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagaggcaacagccugagcggcguggagggcgagggccugcacagacugggcuacauccugagagacgugggcaagaaggagggcggcgccauguacgccgacgacaccgccggcugggacaccagaaucacccuggaggaccugaagaacgaggagauggugaccaaccacaugaagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcaucuucaagagcauccagcaccugaccgccaccgaggagaucgccgugcagaacuggcuggccagagugggcagagagagacugagcagaauggccaucagcggcgacgacugcguggugaagcccaucgacgacagauucgccagcgcccugaccgcccugaacgacaugggcaaggugagaaaggacauccagcagugggagcccagcagaggcuggaacgacuggacccaggugcccuucugcagccaccacuuccacgagcuggugaugaaggacggcagagugcugguggugcccugcagaaaccaggacgagcugaucggcagagccagaaucagccagggcgccggcuggagccugaaggagaccgccugccugggcaagagcuacgcccagauguggacccugauguacuuccacagaagagaccugagacuggccgccaacgccaucugcagcgccgugcccagccacugggugcccaccagcagaaccaccuggagcauccacgccaagcacgaguggaugaccaccgaggacaugcuggccguguggaacagaguguggauccaggagaaccccuggauggaggacaagacccccguggagagcugggaggaggugcccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 17379 - RNA, 9876 nt, Artificial Sequence
  derived and/or modified CDS sequence (opt4) from DENV-2__FJ639733__SS-prME
accgccggcgugaucaucaugcugauccccaccgccauggccuuccaccugaccaccagaaacggcgagccccacaugaucgugggcagacaggagaagggcaagagccugcuguucaagaccgaggacggcgugaacaugugcacccugauggccaucgaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgugcagagaaucgagaccuggauccugagacaccccggcuucaccaucauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaacgaggagcaggacaagagauucaucugcaagcacagcaugguggacagaggcuggggcaacggcugcggccuguucggcaagggcggcaucgugaccugcgccauguucaccugcaagaagaacauggagggcaagguggugcagcccgagaaccuggaguacaccaucgugaucaccccccacagcggcgaggagcacgccgugggcaacgacaccggcaagcacggcaaggagaucaagaucaccccccagagcagcaucaccgaggccgagcugaccggcuacggcaccgugaccauggagugcagccccagaaccggccuggacuucaacgagauggugcugcugcagauggaggacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagaucgugaaggagaucgccgagacccagcacggcaccaucgugaucagagugcaguacgagggcgacggcagccccugcaagauccccuucgagaucaccgaccuggagaagagacacgugcugggcagacugaucaccgugaaccccaucgugaucgagaaggacagccccgugaacaucgaggccgagccccccuucggcgacagcuacaucaucaucggcguggagcccggccagcugaagcugaacugguucaagaagggcagcagcaucggccagauguucgaggccaccaugagaggcgccaagagaauggccauccugggcgacaccgccugggacuucggcagccugggcggcgccuucaccagcaucggcaaggcccugcaccagguguucggcgccaucuacggcgccgccuucagcggcgugagcuggaccaugaagauccugaucggcguggugaucaccuggaucggcaugaacagcagaagcaccagccugagcgugagccuggugcuggugggcguggugacccuguaccugggcgccauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaccaagggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucaccaccaacaucuggcugaagcugagagagaagcaggacguguucugcgacagcaagcugaugagcgccgccaucaaggacaacagagccgugcacgccgacaugggcuacuggaucgagagcgcccugaacgacaccuggaagauggagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcaagcuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugauggccaccaucggcaucacccugcugagccagagcaccauccccgagaccauccuggagcugaccgacgcccuggcccugggcaugauggugcugaagaucgugagaaagauggagaaguaccagcuggccgugaccaucauggccaucagcugcgugcccaacgccgugauccugagaaacgccuggaaggugagcugcaccauccuggccgccgugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggcguguuccccgugagcauccccaucaccgccgccgccugguaccugugggaggugaagaagcagagagccggcgugcugugggacgugcccagccccccccccgugggcaaggccgagcuggaggacggcgccuacagaaucaagcagagaggcauccugggcuacagccagaucggcgccggcguguacaaggagggcaccuuccacaccauguggcacgugaccagaggcgccgugcugaugcacagaggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggcaucuucaagaccaacaccggcaccaucggcgccgugagccuggacuucagccccggcaccagcggcagccccaucguggacagaaagggcaagguggugggccuguacggcaacggcguggugaccagaagcggcgccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucaaggccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagagccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaaaguggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagaaacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcgugcugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucaccacccaggagagcgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggagcccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccaucgaggccggcagaacccugagagugcugaaccugguggagaacuggcugaacaacaacacccaguucugcaucaaggugcugaaccccuacaugcccagcgugaucgagaagauggagacccugcagagaaaguacggcggcgcccuggugagaaacccccugagcagaaacagcacccacgagauguacugggugagcaacgccaccggcaacaucgugagcagcgugaacaugaucagcagaaugcugaucaacagauucaccaugaagcacaagaaggccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacguggugcccauggugacccagauggccaugaccgacaccacccccuucggccagcagagaguguucaaggagaagguggacaccagaacccaggagcccaaggagggcaccaagaagcugaugagaaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacggcagauucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagaggcaacagccugagcggcguggagggcgagggccugcacagacugggcuacauccugagagacgugggcaagaaggagggcggcgccauguacgccgacgacaccgccggcugggacaccagaaucacccuggaggaccugaagaacgaggagauggugaccaaccacaugaagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcaucuucaagagcauccagcaccugaccgccaccgaggagaucgccgugcagaacuggcuggccagagugggcagagagagacugagcagaauggccaucagcggcgacgacugcguggugaagcccaucgacgacagauucgccagcgcccugaccgcccugaacgacaugggcaaggugagaaaggacauccagcagugggagcccagcagaggcuggaacgacuggacccaggugcccuucugcagccaccacuuccacgagcuggugaugaaggacggcagagugcugguggugcccugcagaaaccaggacgagcugaucggcagagccagaaucagccagggcgccggcuggagccugaaggagaccgccugccugggcaagagcuacgcccagauguggacccugauguacuuccacagaagagaccugagacuggccgccaacgccaucugcagcgccgugcccagccacugggugcccaccagcagaaccaccuggagcauccacgccaagcacgaguggaugaccaccgaggacaugcuggccguguggaacagaguguggauccaggagaaccccuggauggaggacaagacccccguggagagcugggaggaggugcccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 17380 - RNA, 9876 nt, Artificial Sequence
  derived and/or modified CDS sequence (opt4) from DENV-2__FJ639734__SS-prME
accgccggcgugaucgugaugcugauccccaccgccaucgccuuccaccugaccaccagaaacggcgagccccacaugaucgugggcagacaggagaagggcaagagccugcuguucaagaccgaggacggcgugaacaugugcacccugauggccaucgaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgugcagagaaucgagaccuggauccugagacaccccggcuucaccaucauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaacgaggagcaggacaagagauucaucugcaagcacagcaugguggacagaggcuggggcaacggcugcggccuguucggcaagggcggcaucgugaccugcgccauguucaccugcaagaagaacauggagggcaagguggugcagcccgagaaccuggaguacaccaucgugaucaccccccacagcggcgaggagcacgccgugggcaacgacaccggcaagcacggcaaggagaucaagaucaccccccagagcagcaucaccgaggccgagcugaccggcuacggcaccgugaccauggagugcagccccagaaccggccuggacuucaacgagauggugcugcugcagauggaggacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagaucgugaaggagaucgccgagacccagcacggcaccaucgugaucagagugcaguacgagggcgacggcagccccugcaagauccccuucgagaucaccgaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcguggugaucaccuggaucggcaugaacagcagaagcaccagccugagcgugagccuggugcuggugggcguggugacccuguaccugggcgccauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaccaagggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucaccaccaacaucuggcugaagcugagagagaagcaggacguguucugcgacagcaagcugaugagcgccgccaucaaggacaacagagccgugcacgccgacaugggcuacuggaucgagagcgcccugaacgacaccuggaagauggagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcaagcuggagauggacuucgaccugugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugauggccaccaucggcaucgcccugcugagccagagcaccauccccgagaccauccuggagcugaccgacgcccuggcccugggcaugauggugcugaagaucgugagaaacauggagaaguaccagcuggccgugaccaucauggccaucagcugcgugcccaacgccgugauccugagaaacgccuggaaggugagcugcaccauccuggccgccgugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgaggugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggcguguuccccgugagcauccccaucaccgccgccgccugguaccugugggaggugaagaagcagagagccggcgugcugugggacgugcccagccccccccccgugggcaaggccgagcuggaggacggcgccuacagaaucaagcagagaggcauccugggcuacagccagaucggcgccggcguguacaaggagggcaccuuccacaccauguggcacgugaccagaggcgccgugcugaugcacagaggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggcaucuucaagaccaacaccggcaccaucggcgccgugagccuggacuucagccccggcaccagcggcagccccaucguggacagaaagggcaagguggugggccuguacggcaacggcguggugaccagaagcggcgccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucaaggccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagagccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaaaguggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagaaacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcgugcugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucaccacccaggagagcgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggagcccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccaucgaggccggcagaacccugagagugcugaaccugguggagaacuggcugaacaacaacacccaguucugcaucaaggugcugaaccccuacaugcccagcgugaucgagaagauggagacccugcagagaaaguacggcggcgcccuggugagaaacccccugagcagaaacagcacccacgagauguacugggugagcaacgccaccggcaacaucgugagcagcgugaacaugaucagcagaaugcugaucaacagauucaccaugaagcacaagaaggccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacguggugcccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacggcagauucugggagcugguggacagagagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagaggcaacagccugagcggcguggagggcgagggccugcacagacugggcuacauccugagagacgugagcaagaaggagggcggcgccauguacgccgacgacaccgccggcugggacaccagaaucacccuggaggaccugaagaacgaggagauggugaccaaccacaugaagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcaucuucaagagcauccagcaccugaccgccaccgaggagaucgccgugcagaacuggcuggccagagugggcagagagagacugagcagaauggccaucagcggcgacgacugcguggugaagcccaucgacgacagauucgccagcgcccugaccgcccugaacgacaugggcaaggugagaaaggacauccagcagugggagcccagcagaggcuggaacgacuggacccaggugcccuucugcagccaccacuuccacgagcuggugaugaaggacggcagagcccugguggugcccugcagaaaccaggacgagcugaucggcagagccagaaccagccagggcgccggcuggagccugaaggagaccgccugccugggcaagagcuacgcccagauguggacccugauguacuuccacagaagagaccugagacuggccgccaacgccaucugcagcgccgugcccagccacugggugcccaccagcagaaccaccuggagcauccacgccaagcacgaguggaugaccaccgaggacaugcuggccguguggaacagaguguggauccaggagaaccccuggauggaggacaagacccccguggagagcugggaggaggugcccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 17381 - RNA, 9876 nt, Artificial Sequence
  derived and/or modified CDS sequence (opt4) from DENV-2__JN819408__SS-prME
accgccggcgugaucgugaugcugauccccaccgccauggccuuccaccugaccaccagaaacggcgagccccacaugaucgugggcagacaggagaagggcaagagccugcuguucaagaccgaggacggcgugaacaugugcacccugauggccaucgaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgugcagagaaucgagaccuggauccugagacaccccggcuucaccaucauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaacgaggagcaggacaagagauucaucugcaagcacagcaugguggacagaggcuggggcaacggcugcggccuguucggcaagggcggcaucgugaccugcgccauguucaccugcaagaagaacauggagggcaagguggugcagcccgagaaccuggaguacaccaucgugaucaccccccacagcggcgaggagcacgccgugggcaacgacaccggcaagcacggcaaggagaucaagaucaccccccagagcagcaucaccgaggccgagcugaccggcuacggcaccgugaccauggagugcagccccagaaccggccuggacuucaacgagauggugcugcugcagauggaggacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagaucgugaaggagaucgccgagacccagcacggcaccaucgugaucagagugcaguacgagggcgacggcagccccugcaagauccccuucgagaucaccgaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcguggugacccuguaccugggcgccauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaccaagggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucaccaccaacaucuggcugaagcugagagagaagcaggacaucuucugcgacagcaagcugaugagcgccgccaucaaggacaacagagccgugcacgccgacaugggcuacuggaucgagagcgcccugaacgacaccuggaagauggagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcaagcuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugauggccaccaucggcaucgcccugcugagccagagcaccauccccgagaccauccuggagcugaccgacgcccuggcccugggcaugauggcccugaagaucgugagaaacauggagaaguaccagcuggccgugaccaucauggccaucagcugcgugcccaacgccgugauccugcagaacgccuggaaggugagcugcaccauccuggccgccgugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggcguguuccccgugagcauccccaucaccgccgccgccugguaccugugggaggugaagaagcagagagccggcgugcugugggacgugcccagccccccccccgugggcaaggccgagcuggaggacggcgccuacagaaucaagcagagaggcauccugggcuacagccagaucggcgccggcguguacaaggagggcaccuuccacaccauguggcacgugaccagaggcgccgugcugaugcacagaggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggcaucuucagaaccaacaccggcaccaucggcgccgugagccuggacuucagccccggcaccagcggcagccccaucguggacagaaagggcaagguggugggccuguacggcaacggcguggugaccagaagcggcgccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucaaggccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagagccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaaaguggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagaaacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucaucacccaggagagcgagaacaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggagcccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccaucgaggccggcagaacccugagagugcugaaccugguggagaacuggcugaacaacaacacccaguucugcaucaaggugcugaaccccuacaugcccagcgugaucgagaagauggagacccugcagagaaaguacggcggcgcccuggugagaaacccccugagcagaaacagcacccacgagauguacugggugagcaacgccaccggcaacaucgugagcagcgugaacaugaucagcagaaugcugaucaacagauucaccaugaagcacaagaaggccaccuacgagcccgacguggaccugggcagcggcaccagaaacaucggcaucgagggcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacguggugcccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccaagaaggugagaagcaacgccgcccugggcgccaucuucaccgacgagaacaaguggaagagcgccagagaggccguggaggacggcagauucugggagcugguggacagagagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagaggcaacagccugagcggcguggagggcgagggccugcacagacugggcuacauccugagagacgugggcaagaaggagggcggcgccauguacgccgacgacaccgccggcugggacaccagaaucacccuggaggaccugaagaacgaggagauggugaccaaccacaugaagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcaucuucaagagcauccagcaccugaccgccaccgaggagaucgccgugcagaacuggcuggccagagugggcagagagagacugagcagaauggccaucagcggcgacgacugcguggugaagcccaucgacgacagauucgccagcgcccugaccgcccugaacgacaugggcaaggugagaaaggacauccagcagugggagcccagcagaggcuggaacgacuggacccaggugcccuucugcagccaccacuuccacgagcuggugaugaaggacggcagagugcugguggugcccugcagaaaccaggacgagcugaucggcagagccagaaucagccagggcgccggcuggagccugaaggagaccgccugccugggcaagagcuacgcccagauguggacccugauguacuuccacagaagagaccugagacuggccgccaacgccaucugcagcgccgugcccagccacugggugcccaccagcagaaccaccuggagcauccacgccaagcacgaguggaugaccaccgaggacaugcuggccguguggaacagaguguggauccaggagaaccccuggauggaggacaagacccccguggagagcugggaggaggugcccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 17382 - RNA, 9876 nt, Artificial Sequence
  derived and/or modified CDS sequence (opt4) from DENV-2__FJ639783__SS-prME
accgccggcgugaucgugaugcugauccccaccgccauggccuuccaccugaccaccagaaacggcgagccccacaugaucgugggcagacaggagaagggcaagagccugcuguucaagaccgaggacggcgugaacaugugcacccugauggccaucgaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgugcagagaaucgagaccuggauccugagacaccccggcuucaccaucauggccgccauccuggccuacaccaucggcaccacccacuuccagagagcccugaucuucauccugcugaccgccguggcccccagcaugaccaugagaugcaucggcgugagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaacgaggagcaggacaagagauucaucugcaagcacagcaugguggacagaggcuggggcaacggcugcggccuguucggcaagggcggcaucgugaccugcgccauguucaccugcaagaagaacauggagggcaagguggugcagcccgagaaccuggaguacaccaucgugaucaccccccacagcggcgaggagcacgccgugggcaacgacaccggcaagcacggcaaggagaucaagaucaccccccagagcagcaucaccgaggccgagcugaccggcuacggcaccgugaccauggagugcagccccagaaccggccuggacuucaacgagauggugcugcugcagauggaggacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagaucgugaaggagaucgccgagacccagcacggcaccaucgugaucagagugcaguacgagggcgacggcagccccugcaagauccccuucgagaucaccgaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcguggugacccuguaccugggcgccauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucaccaccaacaucuggcugaagcugagagagaagcaggacguguucugcgacagcaagcugaugagcgccgccaucaaggacaacagagccgugcacgccgacaugggcuacuggaucgagagcgcccugaacgacaccuggaagauggagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcaagcuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugauggccaccaucggcaucgcccugcugagccagagcaccauccccgagaccauccuggagcugaccgacgcccuggcccugggcaugauggugcugaagaucgugagaaacauggagaaguaccagcuggccgugaccgugauggccaucagcugcgugcccaacgccgugauccugcagaacgccuggaaggugagcugcaccauccuggccgccgugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggcguguuccccgugagcauccccaucaccgccgccgccugguaccugugggaggugaagaagcagagagccggcgugcugugggacgugcccagccccccccccgugggcaaggccgagcuggaggacggcgccuacagaaucaagcagagaggcauccugggcuacagccagaucggcgccggcguguacaaggagggcaccuuccacaccauguggcacgugaccagaggcgccgugcugaugcacagaggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggcaucuucaagaccaacaccggcaccaucggcgccgugagccuggacuucagccccggcaccagcggcagccccaucguggacagaaagggcaagguggugggccuguacggcaacggcguggugaccagaagcggcgccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucaaggccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagagccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaaaguggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagaaacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcgugcugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucaccacccaggagagcgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggagcccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccaucgaggccggcagaacccugagagugcugaaccugguggagaacuggcugaacaacaacacccaguucugcaucaaggugcugaaccccuacaugcccagcgugaucgagaagauggagacccugcagagaaaguacggcggcgcccuggugagaaacccccugagcagaaacagcacccacgagauguacugggugagcaacgccaccggcaacaucgugagcagcgugaacaugaucagcagaaugcugaucaacagauucaccaugaagcacaagaaggccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacguggugcccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacggcagauucugggagcugguggacagagagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagaggcaacagccugagcggcguggagggcgagggccugcacagacugggcuacauccugagagacgugggcaagaaggagggcggcgccauguacgccgacgacaccgccggcugggacaccagaaucacccuggaggaccugaagaacgaggagauggugaccaaccacaugaagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcaucuucaagagcauccagcaccugaccgccaccgaggagaucgccgugcagaacuggcuggccagagugggcagagagagacugagcagaauggccaucagcggcgacgacugcguggugaagcccaucgacgacagauucgccagcgcccugaccgcccugaacgacaugggcaaggugagaaaggacauccagcagugggagcccagcagaggcuggaacgacuggacccaggugcccuucugcagccaccacuuccacgagcuggugaugaaggacggcagagugcugguggugcccugcagaaaccaggacgagcugaucggcagagccagaaucagccagggcgccggcuggagccugaaggagaccgccugccugggcaagagcuacgcccagauguggacccugauguacuuccacagaagagaccugagacuggccgccaacgccaucugcagcgccgugcccagccacugggugcccaccagcagaaccaccuggagcauccacgccaagcacgaguggaugaccaccgaggacaugcuggccguguggaacagaguguggauccaggagaaccccuggauggaggacaagacccccguggagagcugggaggaggugcccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 17383 - RNA, 9876 nt, Artificial Sequence
  derived and/or modified CDS sequence (opt4) from DENV-2__FJ639788__SS-prME
accgccggcgugaucgugaugcugauccccaccgccauggccuuccaccugaccaccagaaacggcgagccccacaugaucgugggcagacaggagaagggcaagagccugcuguucaagaccgaggacggcgugaacaugugcacccugauggccaucgaccugggcgagcugugcgaggacaccaucaccuacaagugcccccugcugagacagaacgagcccgaggacaucgacugcuggugcaacagcaccagcaccugggugaccuacggcaccugcaccaccgccggcgagcacagaagagagaagagaagcguggcccuggugccccacgugggcaugggccuggagaccagaaccgagaccuggaugagcagcgagggcgccuggaagcacgugcagagaaucgagaccuggauccugagacaccccggcuucaccaucauggccgccauccuggccuacaccaucggcaccacccacuuccagagagcccugaucuucauccugcugaccgccguggcccccagcaugaccaugagaugcaucggcgugagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaacgaggagcaggacaagagauucaucugcaagcacagcaugguggacagaggcuggggcaacggcugcggccuguucggcaagggcggcaucgugaccugcgccauguucaccugcaagaagaacauggagggcaagguggugcagcccgagaaccuggaguacaccaucgugaucaccccccacagcggcgaggagcacgccgugggcaacgacaccggcaagcacggcaaggagaucaagaucaccccccagagcagcaucaccgaggccgagcugaccggcuacggcaccgugaccauggagugcagccccagaaccggccuggacuucaacgagauggugcugcugcagauggaggacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagaucgugaaggagaucgccgagacccagcacggcaccaucgugaucagagugcaguacgagggcgacggcagccccugcaagauccccuucgagaucaccgaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcguggugacccuguaccugggcgccauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucaccaccaacaucuggcugaagcugagagagaagcaggacguguucugcgacagcaagcugaugagcgccgccaucaaggacaacagagccgugcacgccgacaugggcuacuggaucgagagcgcccugaacgacaccuggaagauggagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcaagcuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugauggccaccaucggcaucgcccugcugagccagagcaccauccccgagaccauccuggagcugaccgacgcccuggcccugggcaugauggugcugaagaucgugagaaacauggagaaguaccagcuggccgugaccgugauggccaucagcugcgugcccaacgccgugauccugcagaacgccuggaaggugagcugcaccauccuggccgccgugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggcguguuccccgugagcauccccaucaccgccgccgccugguaccugugggaggugaagaagcagagagccggcgugcugugggacgugcccagccccccccccgugggcaaggccgagcuggaggacggcgccuacagaaucaagcagagaggcauccugggcuacagccagaucggcgccggcguguacaaggagggcaccuuccacaccauguggcacgugaccagaggcgccgugcugaugcacagaggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggcaucuucaagaccaacaccggcaccaucggcgccgugagccuggacuucagccccggcaccagcggcagccccaucguggacagaaagggcaagguggugggccuguacggcaacggcguggugaccagaagcggcgccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucaaggccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagagccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaaaguggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagaaacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcgugcugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucaccacccaggagagcgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggagcccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccaucgaggccggcagaacccugagagugcugaaccugguggagaacuggcugaacuacaacacccaguucugcaucaaggugcugaaccccuacaugcccagcgugaucgagaagauggagacccugcagagaaaguacggcggcgcccuggugagaaacccccugagcagaaacagcacccacgagauguacugggugagcaacgccaccggcaacaucgugagcagcgugaacaugaucagcagaaugcugaucaacagauucaccaugaagcacaagaaggccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacguggugcccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacggcagauucugggagcugguggacagagagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagaggcaacagccugagcggcguggagggcgagggccugcacagacugggcuacauccugagagacgugggcaagaaggagggcggcgccauguacgccgacgacaccgccggcugggacaccagaaucacccuggaggaccugaagaacgaggagauggugaccaaccacaugaagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcaucuucaagagcauccagcaccugaccgccaccgaggagaucgccgugcagaacuggcuggccagagugggcagagagagacugagcagaauggccaucagcggcgacgacugcguggugaagcccaucgacgacagauucgccagcgcccugaccgcccugaacgacaugggcaaggugagaaaggacauccagcagugggagcccagcagaggcuggaacgacuggacccaggugcccuucugcagccaccacuuccacgagcuggugaugaaggacggcagagugcugguggugcccugcagaaaccaggacgagcugaucggcagagccagaaucagccagggcgccggcuggagccugaaggagaccgccugccugggcaagagcuacgcccagauguggacccugauguacuuccacagaagagaccugagacuggccgccaacgccaucugcagcgccgugcccagccacugggugcccaccagcagaaccaccuggagcauccacgccaagcacgaguggaugaccaccgaggacaugcuggccguguggaacagaguguggauccaggagaaccccuggauggaggacaagacccccguggagagcugggaggaggugcccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 17384 - RNA, 9876 nt, Artificial Sequence
  derived and/or modified CDS sequence (opt4) from DENV-2__FJ639822__SS-prME
accgccggcgugaucgugaugcugauccccaccgccauggccuuccaccugaccaccagaaacggcgagccccacaugaucgugggcagacaggagaagggcaagagccugcuguucaagaccgaggacggcgugaacaugugcacccugauggccaucgaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgugcagagaaucgagaccuggauccugagacaccccggcuucaccaucauggccgccauccuggccuacaccaucggcaccacccacuuccagagagcccugaucuucauccugcugaccgccguggcccccagcaugaccaugagaugcaucggcgugagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaacgaggagcaggacaagagauucaucugcaagcacagcaugguggacagaggcuggggcaacggcugcggccuguucggcaagggcggcaucgugaccugcgccauguucaccugcaagaagaacauggagggcaagguggugcagcccgagaaccuggaguacaccaucgugaucaccccccacagcggcgaggagcacgccgugggcaacgacaccggcaagcacggcaaggagaucaagaucaccccccagagcagcaucaucgaggccgagcugaccggcuacggcaccgugaccauggagugcagccccagaaccggccuggacuucaacgagauggugcugcugcagauggaggacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagaucgugaaggagaucgccgagacccagcacggcaccaucgugaucagagugcaguacgagggcgacggcagccccugcaagauccccuucgagaucaccgaccuggagaagagacacgugcugggcagacugaucaccgugaaccccaucgugaccggcaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcguggugacccuguaccugggcgccauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucaccaccaacaucuggcugaagcugagagagaagcaggacguguucugcgacagcaagcugaugagcgccgccaucaaggacaacagagccgugcacgccgacaugggcuacuggaucgagagcgcccugaacgacaccuggaagauggagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcaagcuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugauggccaccaucggcaucgcccugcugagccagagcaccauccccgagaccauccuggagcugaccgacgcccuggcccugggcaugauggugcugaagaucgugagaaacauggagaaguaccagcuggccgugaccgugauggccaucagcugcgugcccaacgccgugauccugcagaacgccuggaaggugagcugcaccauccuggccgccgugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggcguguuccccgugagcauccccaucaccgccgccgccugguaccugugggaggugaagaagcagagagccggcgugcugugggacgugcccagccccccccccgugggcaaggccgagcuggaggacggcgccuacagaaucaagcagagaggcauccugggcuacagccagaucggcgccggcguguacaaggagggcaccuuccacaccauguggcacgugaccagaggcgccgugcugaugcacagaggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggcaucuucaagaccaacaccggcaccaucggcgccgugagccuggacuucagccccggcaccagcggcagccccaucguggacagaaagggcaagguggugggccuguacggcaacggcguggugaccagaagcggcgccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucaaggccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagagccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaaaguggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccuggcccugaaccugaucaccgagaugggcagacugcccaccuucaugacccagaaggccagaaacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcgugcugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucaccacccaggagagcgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggagcccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccaucgaggccggcagaacccugagagugcugaaccugguggagaacuggcugaacaacaacacccaguucugcaucaaggugcugaaccccuacaugcccagcgugaucgagaagauggagacccugcagagaaaguacggcggcgcccuggugagaaacccccugagcagaaacagcacccacgagauguacugggugagcaacgccaccggcaacaucgugagcagcgugaacaugaucagcagaaugcugaucaacagauucaccaugaagcacaagaaggccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacguggugcccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacggcagauucugggagcugguggacagagagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagaggcaacagccugagcggcguggagggcgagggccugcacagacugggcuacauccugagagacgugggcaagaaggagggcggcgccauguacgccgacgacaccgccggcugggacaccagaaucacccuggaggaccugaagaacgaggagauggugaccaaccacaugaagggcgagcacaagaagcuggccgaggccaucuucaagcugaccuaccagaacaagguggugagagugcagagacccacccccagaggcaccgugauggacaucaucagcagaaaggaccagagaggcagcggccaggugggcaccuacggccugaacaccuucaccaacauggaggcccagcugaucagacagauggagggcgagggcaucuucaagagcauccagcaccugaccgccaccgaggagaucgccgugcagaacuggcugaccagagugggcagagagagacugagcagaauggccaucagcggcgacgacugcguggugaagcccaucgacgacagauucgccagcgcccugaccgcccugaacgacaugggcaaggugagaaaggacauccagcagugggagcccagcagaggcuggaacgacuggacccaggugcccuucugcagccaccacuuccacgagcuggugaugaaggacggcagagugcugguggugcccugcagaaaccaggacgagcugaucggcagagccagaaucagccagggcgccggcuggagccugaaggagaccgccugccugggcaagagcuacgcccagauguggacccugauguacuuccacagaagagaccugagacuggccgccaacgccaucugcagcgccgugcccagccacugggugcccaccagcagaaccaccuggagcauccacgccaagcacgaguggaugaccaccgaggacaugcuggccguguggaacagaguguggauccaggagaaccccuggauggaggacaagacccccguggagagcugggaggaggugcccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 17385 - RNA, 9876 nt, Artificial Sequence
  derived and/or modified CDS sequence (opt4) from DENV-2__FJ850112__SS-prME
accgccggcgugaucaucaugcugauccccaccgccauggccuuccaccugaccaccagaaacggcgagccccacaugaucgugggcagacaggagaagggcaagagccugcuguucaagaccgaggacggcgugaacaugugcacccugauggccaucgaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgugcagagaaucgagaccuggauccugagacaccccggcuucaccaucauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaacgaggagcaggacaagagauucaucugcaagcacagcaugguggacagaggcuggggcaacggcugcggccuguucggcaagggcggcaucgugaccugcgccauguucaccugcaagaagaacauggagggcaagguggugcagcccgagaaccuggaguacaccaucgugaucaccccccacagcggcgaggagcacgccgugggcaacgacaccggcaagcacggcaaggagaucaagaucaccccccagagcagcaucaccgaggccgagcugaccggcuacggcaccgugaccauggagugcagccccagaaccggccuggacuucaacgagauggugcugcugcagauggaggacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagaucgugaaggagaucgccgagacccagcacggcaccaucgugaucagagugcaguacgagggcgacggcagccccugcaagauccccuucgagaucaccgaccuggagaagagacacgugcugggcagacugaucaccgugaaccccaucgugaucgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcgccuucaccagcaucggcaaggcccugcaccagguguucggcgccaucuacggcgccgccuucagcggcgugagcuggaccaugaagauccugaucggcguggugaucaccuggaucggcaugaacagcagaagcaccagccugagcgugagccuggugcuggugggcguggugacccuguaccugggcgccauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaccaagggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucaccaccaacaucuggcugaagcugagagagaagcaggacguguucugcgacagcaagcugaugagcgccgccaucaaggacaacagagccgugcacgccgacaugggcuacuggaucgagagcgcccugaacgacaccuggaagauggagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcaagcuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugauggccaccaucggcaucacccugcugagccagagcaccauccccgagaccauccuggagcugaccgacgcccuggcccugggcaugauggugcugaagaucgugagaaagauggagaaguaccagcuggccgugaccaucauggccaucagcugcgugcccaacgccgugauccugagaaacgccuggaaggugagcugcaccauccuggccgccgugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggcguguuccccgugagcauccccaucaccgccgccgccugguaccugugggaggugaagaagcagagagccggcgugcugugggacgugcccagccccccccccgugggcaaggccgagcuggaggacggcgccuacagaaucaagcagagaggcauccugggcuacagccagaucggcgccggcguguacaaggagggcaccuuccacaccauguggcacgugaccagaggcgccgugcugaugcacagaggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggcaucuucaagaccaacaccggcaccaucggcgccgugagccuggacuucagccccggcaccagcggcagccccaucguggacagaaagggcaagguggugggccuguacggcaacggcguggugaccagaagcggcgccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucaaggccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagagccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaaaguggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagaaacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcgugcugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucaccacccaggagagcgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggagcccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccaucgaggccggcagaacccugagagugcugaaccugguggagaacuggcugaacaacaacacccaguucugcaucaaggugcugaaccccuacaugcccagcgugaucgagaagauggagacccugcagagaaaguacggcggcgcccuggugagaaacccccugagcagaaacagcacccacgagauguacugggugagcaacgccaccggcaacaucgugagcagcgugaacaugaucagcagaaugcugaucaacagauucaccaugaagcacaagaaggccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacguggugcccauggugacccagauggccaugaccgacaccacccccuucggccagcagagaguguucaaggagaagguggacaccagaacccaggagcccaaggagggcaccaagaagcugaugagaaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacggcagauucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagaggcaacagccugagcggcguggagggcgagggccugcacagacugggcuacauccugagagacgugggcaagaaggagggcggcgccauguacgccgacgacaccgccggcugggacaccagaaucacccuggaggaccugaagaacgaggagauggugaccaaccacaugaagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcaucuucaagagcauccagcaccugaccgccaccgaggagaucgccgugcagaacuggcuggccagagugggcagagagagacugagcagaauggccaucagcggcgacgacugcguggugaagcccaucgacgacagauucgccagcgcccugaccgcccugaacgacaugggcaaggugagaaaggacauccagcagugggagcccagcagaggcuggaacgacuggacccaggugcccuucugcagccaccacuuccacgagcuggugaugaaggacggcagagugcugguggugcccugcagaaaccaggacgagcugaucggcagagccagaaucagccagggcgccggcuggagccugaaggagaccgccugccugggcaagagcuacgcccagauguggacccugauguacuuccacagaagagaccugagacuggccgccaacgccaucugcagcgccgugcccagccacugggugcccaccagcagaaccaccuggagcauccacgccaagcacgaguggaugaccaccgaggacaugcuggccguguggaacagaguguggauccaggagaaccccuggauggaggacaagacccccguggagagcugggaggaggugcccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 17386 - RNA, 9876 nt, Artificial Sequence
  derived and/or modified CDS sequence (opt4) from DENV-2__FJ850105__SS-prME
accgccggcgugaucaucaugcugauccccaccgccauggccuuccaccugaccaccagaaacggcgagccccacaugaucgugggcagacaggagaagggcaagagccugcuguucaagaccgaggacggcgugaacaugugcacccugauggccaucgaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgugcagagaaucgagaccuggauccugagacaccccggcuucaccaucauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaacgaggagcaggacaagagauucaucugcaagcacagcaugguggacagaggcuggggcaacggcugcggccuguucggcaagggcggcaucgugaccugcgccauguucaccugcaagaagaacauggagggcaagguggugcagcccgagaaccuggaguacaccaucgugaucaccccccacagcggcgaggagcacgccgugggcaacgacaccggcaagcacggcaaggagaucaagaucaccccccagagcagcaucaccgaggccgagcugaccggcuacggcaccgugaccauggagugcagccccagaaccggccuggacuucaacgagauggugcugcugcagauggaggacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagaucgugaaggagaucgccgagacccagcacggcaccaucgugaucagaauccaguacgagggcgacggcagccccugcaagauccccuucgagaucaccgaccuggagaagagacacgugcugggcagacugaucaccgugaaccccaucgugaucgagaaggacagccccgugaacaucgaggccgagccccccuucggcgacagcuacaucaucaucggcgccgagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcguggugaucaccuggaucggcaugaacagcagaagcaccagccugagcgugagccuggugcuggugggcguggugacccuguaccugggcgccauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaccaagggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucaccaccaacaucuggcugaagcugagagagaagcaggacguguucugcgacagcaagcugaugagcgccgccaucaaggacaacagagccgugcacgccgacaugggcuacuggaucgagagcgcccugaacgacaccuggaagauggagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcaagcuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugauggccaccaucggcaucacccugcugagccagagcaccauccccgagaccauccuggagcugaccgacgcccuggcccugggcaugauggugcugaagaucgugagaaacauggagaaguaccagcuggccgugaccaucauggccaucagcugcgugcccaacgccgugauccugagaaacgccuggaaggugagcugcaccauccuggccgccgugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggcguguuccccgugagcauccccaucaccgccgccgccugguaccugugggaggugaagaagcagagagccggcgugcugugggacgugcccagccccccccccgugggcaaggccgagcuggaggacggcgccuacagaaucaagcagagaggcauccugggcuacagccagaucggcgccggcguguacaaggagggcaccuuccacaccauguggcacgugaccagaggcgccgugcugaugcacagaggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggcaucuucaagaccaacaccggcaccaucggcgccgugagccuggacuucagccccggcaccagcggcagccccaucguggacagaaagggcaagguggugggccuguacggcaacggcguggugaccagaagcggcgccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucaaggccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagagccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaaaguggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagaaacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcgugcugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucaccacccaggagagcgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggagcccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccaucgaggccggcagaacccugagagugcugaaccugguggagaacuggcugaacaacaacacccaguucugcaucaaggugcugaaccccuacaugcccagcgugaucgagaagauggagacccugcagagaaaguacggcggcgcccuggugagaaacccccugagcagaaacagcacccacgagauguacugggugagcaacgccaccggcaacaucgugagcagcgugaacaugaucagcagaaugcugaucaacagauucaccaugaagcacaagaaggccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacguggugcccauggugacccagauggccaugaccgacaccacccccuucggccagcagagaguguucaaggagaagguggacaccagaacccaggagcccaaggagggcaccaagaagcugaugagaaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacggcagauucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagaggcaacagccugagcggcguggagggcgagggccugcacagacugggcuacauccugagagacgugggcaagaaggagggcggcgccauguacgccgacgacaccgccggcugggacaccagaaucacccuggaggaccugaagaacgaggagauggugaccaaccacaugaagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcaucuucaagagcauccagcaccugaccgccaccgaggagaucgccgugcagaacuggcuggccagagugggcagagagagacugagcagaauggccaucagcggcgacgacugcguggugaagcccaucgacgacagauucgccagcgcccugaccgcccugaacgacaugggcaaggugagaaaggacauccagcagugggagcccagcagaggcuggaacgacuggacccaggugcccuucugcagccaccacuuccacgagcuggugaugaaggacggcagagugcugguggugcccugcagaaaccaggacgagcugaucggcagagccagaaucagccagggcgccggcuggagccugaaggagaccgccugccugggcaagagcuacgcccagauguggacccugauguacuuccacagaagagaccugagacuggccgccaacgccaucugcagcgccgugcccagccacugggugcccaccagcagaaccaccuggagcauccacgccaagcacgaguggaugaccaccgaggacaugcuggccguguggaacagaguguggauccaggagaaccccuggauggaggacaagacccccguggagagcugggaggaggugcccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 17387 - RNA, 9876 nt, Artificial Sequence
  derived and/or modified CDS sequence (opt4) from DENV-2__FJ850106__SS-prME
accgccggcgugaucaucaugcugauccccaccgccauggccuuccaccugaccaccagaaacggcgagccccacaugaucgugggcagacaggagaagggcaagagccugcuguucaagaccgaggacggcgugaacaugugcacccugauggccaucgaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgugcagagaaucgagaccuggauccugagacaccccggcuucaccaucauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaacgaggagcaggacaagagauucaucugcaagcacagcaugguggacagaggcuggggcaacggcugcggccuguucggcaagggcggcaucgugaccugcgccauguucaccugcaagaagaacauggagggcaagguggugcagcccgagaaccuggaguacaccaucgugaucaccccccacagcggcgaggagcacgccgugggcaacgacaccggcaagcacggcaaggagaucaagaucaccccccagagcagcaucaccgaggccgagcugaccggcuacggcaccgugaccauggagugcagccccagaaccggccuggacuucaacgagauggugcugcugcagauggaggacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagaucgugaaggagaucgccgagacccagcacggcaccaucgugaucagaauccaguacgagggcgacggcagccccugcaagauccccuucgagaucaccgaccuggagaagagacacgugcugggcagacugaucaccgugaaccccaucgugaucgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcguggugaucaccuggaucggcaugaacagcagaagcaccagccugagcgugagccuggugcuggugggcguggugacccuguaccugggcgccauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaccaagggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucaccaccaacaucuggcugaagcugagagagaagcaggacguguucugcgacagcaagcugaugagcgccgccaucaaggacaacagagccgugcacgccgacaugggcuacuggaucgagagcgcccugaacgacaccuggaagauggagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcaagcuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccacccugcugguggccgccagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugauggccaccaucggcaucacccugcugagccagagcaccauccccgagaccauccuggagcugaccgacgcccuggcccugggcaugauggugcugaagaucgugagaaacauggagaaguaccagcuggccgugaccaucauggccaucagcugcgugcccaacgccgugauccugagaaacgccuggaaggugagcugcaccauccuggccgccgugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggcguguuccccgugagcauccccaucaccgccgccgccugguaccugugggaggugaagaagcagagagccggcgugcugugggacgugcccagccccccccccgugggcaaggccgagcuggaggacggcgccuacagaaucaagcagagaggcauccugggcuacagccagaucggcgccggcguguacaaggagggcaccuuccacaccauguggcacgugaccagaggcgccgugcugaugcacagaggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggcaucuucaagaccaacaccggcaccaucggcgccgugagccuggacuucagccccggcaccagcggcagccccaucguggacagaaagggcaagguggugggccuguacggcaacggcguggugaccagaagcggcgccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucaaggccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagagccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaaaguggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagaaacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcgugcugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucaccacccaggagagcgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggagcccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccaucgaggccggcagaacccugagagugcugaaccugguggagaacuggcugaacaacaacacccaguucugcaucaaggugcugaaccccuacaugcccagcgugaucgagaagauggagacccugcagagaaaguacggcggcgcccuggugagaaacccccugagcagaaacagcacccacgagauguacugggugagcaacgccaccggcaacaucgugagcagcgugaacaugaucagcagaaugcugaucaacagauucaccaugaagcacaagaaggccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacguggugcccauggugacccagauggccaugaccgacaccacccccuucggccagcagagaguguucaaggagaagguggacaccagaacccaggagcccaaggagggcaccaagaagcugaugagaaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacggcagauucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagaggcaacagccugagcggcguggagggcgagggccugcacagacugggcuacauccugagagacgugggcaagaaggagggcggcgccauguacgccgacgacaccgccggcugggacaccagaaucacccuggaggaccugaagaacgaggagauggugaccaaccacaugaagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcaucuucaagagcauccagcaccugaccgccaccgaggagaucgccgugcagaacuggcuggccagagugggcagagagagacugagcagaauggccaucagcggcgacgacugcguggugaagcccaucgacgacagauucgccagcgcccugaccgcccugaacgacaugggcaaggugagaaaggacauccagcagugggagcccagcagaggcuggaacgacuggacccaggugcccuucugcagccaccacuuccacgagcuggugaugaaggacggcagagugcugguggugcccugcagaaaccaggacgagcugaucggcagagccagaaucagccagggcgccggcuggagccugaaggagaccgccugccugggcaagagcuacgcccagauguggacccugauguacuuccacagaagagaccugagacuggccgccaacgccaucugcagcgccgugcccagccacugggugcccaccagcagaaccaccuggagcauccacgccaagcacgaguggaugaccaccgaggacaugcuggccguguggaacagaguguggauccaggagaaccccuggauggaggacaagacccccguggagagcugggaggaggugcccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 17388 - RNA, 9876 nt, Artificial Sequence
  derived and/or modified CDS sequence (opt4) from DENV-2__FJ850107__SS-prME
accgccggcgugaucaucaugcugauccccaccgccauggccuuccaccugaccaccagaaacggcgagccccacaugaucgugggcagacaggagaagggcaagagccugcuguucaagaccgaggacggcgugaacaugugcacccugauggccaucgaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgugcagagaaucgagaccuggauccugagacaccccggcuucaccaucauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaacgaggagcaggacaagagauucaucugcaagcacagcaugguggacagaggcuggggcaacggcugcggccuguucggcaagggcggcaucgugaccugcgccauguucaccugcaagaagaacauggagggcaagguggugcagcccgagaaccuggaguacaccaucgugaucaccccccacagcggcgaggagcacgccgugggcaacgacaccggcaagcacggcaaggagaucaagaucaccccccagagcagcaucaccgaggccgagcugaccggcuacggcaccgugaccauggagugcagccccagaaccggccuggacuucaacgagauggugcugcugcagauggaggacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagaucgugaaggagaucgccgagacccagcacggcaccaucgugaucagaauccaguacgagggcgacggcagccccugcaagauccccuucgagaucaccgaccuggagaagagacacgugcugggcagacugaucaccgugaaccccaucgugaucgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcguggugaucaccuggaucggcaugaacagcagaagcaccagccugagcgugagccuggugcuggugggcguggugacccuguaccugggcgccauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaccaagggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucaccaccaacaucuggcugaagcugagagagaagcaggacguguucugcgacagcaagcugaugagcgccgccaucaaggacaacagagccgugcacgccgacaugggcuacuggaucgagagcgcccugaacgacaccuggaagauggagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcaagcuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugauggccaccaucggcaucacccugcugagccagagcaccauccccgagaccauccuggagcugaccgacgcccuggcccugggcaugauggugcugaagaucgugagaaacauggagaaguaccagcuggccgugaccaucauggccaucagcugcgugcccaacgccgugauccugagaaacgccuggaaggugagcugcaccauccuggccgccgugagcguguucccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggcguguuccccgugagcauccccaucaccgccgccgccugguaccugugggaggugaagaagcagagagccggcgugcugugggacgugcccagccccccccccgugggcaaggccgagcuggaggacggcgccuacagaaucaagcagagaggcauccugggcuacagccagaucggcgccggcguguacaaggagggcaccuuccacaccauguggcacgugaccagaggcgccgugcugaugcacagaggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggcaucuucaagaccaacaccggcaccaucggcgccgugagccuggacuucagccccggcaccagcggcagccccaucguggacagaaagggcaagguggugggccuguacggcaacggcguggugaccagaagcggcgccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucaaggccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagagccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaaaguggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcaagcugcccaccuucaugacccagaaggccagaaacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcgugcugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucaccacccaggagagcgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggagcccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccaucgaggccggcagaacccugagagugcugaaccugguggagaacuggcugaacaacaacacccaguucugcaucaaggugcugaaccccuacaugcccagcgugaucgagaagauggagacccugcagagaaaguacggcggcgcccuggugagaaacccccugagcagaaacagcacccacgagauguacugggugagcaacgccaccggcaacaucgugagcagcgugaacaugaucagcagaaugcugaucaacagauucaccaugaagcacaagaaggccaccuacgagcccgacguggaccugggcagcggcaccagaaacaucggcaucgagagcgagauccccaaccuggacaucaucggcaagagaaucgagaagaucagacaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacguggugcccauggugacccagauggccaugaccgacaccacccccuucggccagcagagaguguucaaggagaagguggacaccagaacccaggagcccaaggagggcaccaagaagcugaugagaaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacggcagauucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagaggcaacagccugagcggcguggagggcgagggccugcacagacugggcuacauccugagagacgugggcaagaaggagggcggcgccauguacgccgacgacaccgccggcugggacaccagaaucacccuggaggaccugaagaacgaggagauggugaccaaccacaugaagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcaucuucaagagcauccagcaccugaccgccaccgaggagaucgccgugcagaacuggcuggccagagugggcagagagagacugagcagaauggccaucagcggcgacgacugcguggugaagcccaucgacgacagauucgccagcgcccugaccgcccugaacgacaugggcaaggugagaaaggacauccagcagugggagcccagcagaggcuggaacgacuggacccaggugcccuucugcagccaccacuuccacgagcuggugaugaaggacggcagagugcugguggugcccugcagaaaccaggacgagcugaucggcagagccagaaucagccagggcgccggcuggagccugaaggagaccgccugccugggcaagagcuacgcccagauguggacccugauguacuuccacagaagagaccugagacuggccgccaacgccaucugcagcgccgugcccagccacugggugcccaccagcagaaccaccuggagcauccacgccaagcacgaguggaugaccaccgaggacaugcuggccguguggaacagaguguggauccaggagaaccccuggauggaggacaagacccccguggagagcugggaggaggugcccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 17389 - RNA, 9876 nt, Artificial Sequence
  derived and/or modified CDS sequence (opt4) from DENV-2__FJ850108__SS-prME
accgccggcgugaucgugaugcugauccccaccgccauggccuuccaccugaccaccagaaacggcgagccccacaugaucgugggcagacaggagaagggcaagagccugcuguucaagaccgaggacggcgugaacaugugcacccugauggccaucgaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgugcagagaaucgagaccuggauccugagacaccccggcuucaccaucauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaacgaggagcaggacaagagauucaucugcaagcacagcaugguggacagaggcuggggcaacggcugcggccuguucggcaagggcggcaucgugaccugcgccauguucaccugcaagaagaacauggagggcaagguggugcagcccgagaaccuggaguacaccaucgugaucaccccccacagcggcgaggagcacgccgugggcaacgacaccggcaagcacggcaaggagaucaagaucaccccccagagcagcaucaccgaggccgagcugaccggcuacggcaccgugaccauggagugcagccccagaaccggccuggacuucaacgagauggugcugcugcagauggaggacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagaucgugaaggagaucgccgagacccagcacggcaccaucgugaucagagugcaguacgagggcgacggcagccccugcaagauccccuucgagaucaccgaccuggagaagagacacgugcugggcagacugaucaccgugaaccccaucgugaucgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcguggugaucaccuggaucggcaugaacagcagaagcaccagccugagcgugagccuggugcuggugggcguggugacccuguaccugggcgccauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaccaagggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucaccaccaacaucuggcugaagcugagagagaagcaggacguguucugcgacagcaagcugaugagcgccgccaucaaggacaacagagccgugcacgccgacaugggcuacuggaucgagagcgcccugaacgacaccuggaagauggagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaucgccggccccuggcaccugggcaagcuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugguggccgugagcuucgugacccugaucaccggcaacaugagcuucagagaccugggcagaaugauggugauggugggcgccaccaugaccgacgacaucggcaugggcgugaccuaccuggcccugcuggccgccuucaaggugagacccaccuucguggccggccugcugcugagaaagcugaccagcaaggagcugaugauggccaccaucggcaucacccugcugagccagagcaccauccccgagaccauccuggagcugaccgacgcccuggcccugggcaugauggugcugaagaucgugagaaacauggagaaguaccagcuggccgugaccaucauggccaucagcugcgugcccaacgccgugauccugagaaacgccuggaaggugagcugcaccauccuggccgccgugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggcguguuccccgugagcauccccaucaccgccgccgccugguaccugugggaggugaagaagcagagagccggcgugcugugggacgugcccagccccccccccgugggcaaggccgagcuggaggacggcgccuacagaaucaagcagagaggcauccugggcuacagccagaucggcgccggcguguacaaggagggcaccuuccacaccauguggcacgugaccagaggcgccgugcugaugcacagaggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggcaucuucaagaccaacaccggcaccaucggcgccgugagccuggacuucagccccggcaccagcggcagccccaucguggacagaaagggcaagguggugggccuguacggcaacggcguggugaccagaagcggcgccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucaaggccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagagccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaaaguggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagaaacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcgugcugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucaccacccaggagcccgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggagcccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccaucgaggccggcagaacccugagagugcugaaccugguggagaacuggcugaacaacaacacccaguucugcaucaaggugcugaaccccuacaugcccagcgugaucgagaagauggagacccugcagagaaaguacggcggcgcccuggugagaaacccccugagcagaaacagcacccacgagauguacugggugagcaacgccaccggcaacaucgugagcagcgugaacaugaucagcagaaugcugaucaacagauucaccaugaagcacaagaaggccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacguggugcccauggugacccagauggccaugaccgacaccacccccuucggccagcagagaguguucaaggagaagguggacaccagaacccaggagcccaaggagggcaccaagaagcugaugagaaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacggcagauucugggagcugguggacagagagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagaggcaacagccugagcggcguggagggcgagggccugcacagacugggcuacauccugagagacgugggcaagaaggagggcggcgccauguacgccgacgacaccgccggcugggacaccagaaucacccuggaggaccugaagaacgaggagauggugaccaaccacaugaagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcaucuucaagagcauccagcaccugaccgugaccgaggagaucgccgugcagaacuggcuggccagagugggcagagagagacugagcagaauggccaucagcggcgacgacugcguggugaagcccaucgacgacagauucgccagcgcccugaccgcccugaacgacaugggcaaggugagaaaggacauccagcagugggagcccagcagaggcuggaacgacuggacccaggugcccuucugcagccaccacuuccacgagcuggugaugaaggacggcagagugcugguggugcccugcagaaaccaggacgagcugaucggcagagccagaaucagccagggcgccggcuggagccugaaggagaccgccugccugggcaagagcuacgcccagauguggacccugauguacuuccacagaagagaccugagacuggccgccaacgccaucugcagcgccgugcccagccacugggugcccaccagcagaaccaccuggagcauccacgccaagcacgaguggaugaccaccgaggacaugcuggccguguggaacagaguguggauccaggagaaccccuggauggaggacaagacccccguggagagcugggaggaggugcccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 17390 - RNA, 9876 nt, Artificial Sequence
  derived and/or modified CDS sequence (opt4) from DENV-2__JN819407__SS-prME
accgccggcgugaucgugaugcugauccccaccgccauggccuuccaccugaccaccagaaacggcgagccccacaugaucgugggcagacaggagaagggcaagagccugcuguucaagaccgaggacggcgugaacaugugcacccugauggccaucgaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgugcagagaaucgagaccuggauccugagacaccccggcuucaccaucauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaacgaggagcaggacaagagauucaucugcaagcacagcaugguggacagaggcuggggcaacggcugcggccuguucggcaagggcggcaucgugaccugcgccauguucaccugcaagaagaacauggagggcaagguggugcagcccgagaaccuggaguacaccaucgugaucaccccccacagcggcgaggagcacgccgugggcaacgacaccggcaagcacggcaaggagaucaagaucaccccccagagcagcaucaccgaggccgagcugaccggcuacggcaccgugaccauggagugcagccccagaaccggccuggacuucaacgagauggugcugcugcagauggaggacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagccugggcaaccugcuguucaccggccaccugaagugcagacugagaauggacaagcugcagcugaagggcaugagcuacagcaugugcaccggcaaguucaagaucgugaaggagaucgccgagacccagcacggcaccaucgugaucagagugcaguacgagggcgacggcagccccugcaagauccccuucgagaucaccgaccuggagaagagacacgugcugggcagacugaucaccgugaaccccaucgugaucgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcguggugaucaccuggaucggcaugaacagcagaagcaccagccugagcgugagccuggugcuggugggcguggugacccuguaccugggcgccauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaccaagggcaucaugcaggccggcaagagaagccugagaccccagcccaccgagcugaaguacagcuggaagaccuggggcaaggccaagaugcuguucaccgagagccacaaccagaccuuccugaucgacggccccgagaccgccgagugccccaacaccaacagagccuggaacagccuggagguggaggacuacggcuucggcguguucagcaccaacaucuggcugaagcugagagagaagcaggacguguucugcgacagcaagcugaugagcgccgccaucaaggacaacagagccgugcacgccgacaugggcuacuggaucgagagcgcccugaacgacaccuggaagauggagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcaagcuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugauggccaccaucggcaucacccugcugagccagagcaccauccccgagaccauccuggagcugaccgacgcccuggcccugggcaugauggugcugaagaucgugagaaacauggagaaguaccagcuggccgugaccaucauggccaucagcugcgugcccaacgccgugauccugagaaacgccuggaaggugagcugcaccauccuggccgccgugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggcguguuccccgugagcauccccaucaccgccgccgccugguaccugugggaggugaagaagcagagagccggcgugcugugggacgugcccagccccccccccgugggcaaggccgagcuggaggacggcgccuacagaaucaagcagagaggcauccugggcuacagccagaucggcgccggcguguacaaggagggcaccuuccacaccauguggcacgugaccagaggcgccgugcugaugcacagaggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggcaucuucaagaccaacaccggcaccaucggcgccgugagccuggacuucagccccggcaccagcggcagccccaucguggacagaaagggcaagguggugggccuguacggcaacggcguggugaccagaagcggcgccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucaaggccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagagccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaaaguggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagaaacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcgugcugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucaccacccaggagcccgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggagcccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccaucgaggccggcagaacccugagagugcugaaccugguggagaacuggcugaacaacaacacccaguucugcaucaaggugcugaaccccuacaugcccagcgugaucgagaagauggagacccugcagagaaaguacggcggcgcccuggugagaaacccccugagcagaaacagcacccacgagauguacugggugagcaacgccaccggcaacaucgugagcagcgugaacaugaucagcagaaugcugaucaacagauucaccaugaagcacaagaaggccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacguggugcccauggugacccagauggccaugaccgacaccacccccuucggccagcagagaguguucaaggagaagguggacaccagaacccaggagcccaaggagggcaccaagaagcugaugagaaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacggcagauucugggagcugguggacagagagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagaggcaacagccugagcggcguggagggcgagggccugcacagacugggcuacauccugagagacgugggcaagaaggagggcggcgccauguacgccgacgacaccgccggcugggacaccagaaucacccuggaggaccugaagaacgaggagauggugaccaaccacaugaagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcaucuucaagagcauccagcaccugaccgugaccgaggagaucgccgugcagaacuggcuggccagagugggcagagagagacugagcagaauggccaucagcggcgacgacugcguggugaagcccaucgacgacagauucgccagcgcccugaccgcccugaacgacaugggcaaggugagaaaggacauccagcagugggagcccagcagaggcuggaacgacuggacccaggugcccuucugcagccaccacuuccacgagcuggugaugaaggacggcagagugcugguggugcccugcagaaaccaggacgagcugaucggcagagccagaaucagccagggcgccggcuggagccugaaggagaccgccugccugggcaagagcuacgcccagauguggacccugauguacuuccacagaagagaccugagacuggccgccaacgccaucugcagcgccgugcccagccacugggugcccaccagcagaaccaccuggagcauccacgccaagcacgaguggaugaccaccgaggacaugcuggccguguggaacagaguguggauccaggagaaccccuggauggaggacaagacccccguggagagcugggaggaggugcccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 17391 - RNA, 9876 nt, Artificial Sequence
  derived and/or modified CDS sequence (opt4) from DENV-2__FJ898465__SS-prME
accgccggcgugaucaucaugcugauccccaccgccauggccuuccaccugaccaccagaaacggcgagccccacaugaucgugggcagacaggagaagggcaagagccugcuguucaagaccgaggacggcgugaacaugugcacccugauggccaucgaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgugcagagaaucgagaccuggauccugagacaccccggcuucgccaucauggccgccauccuggccuacaccaucggcaccacccacuuccagaaggcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaacgaggagcaggacaagagauucaucugcaagcacagcaugguggacagaggcuggggcaacggcugcggccuguucggcaagggcggcaucgugaccugcgccauguucaccugcaagaagaacauggagggcaagguggugcugcccgagaaccuggaguacaccaucgugaucaccccccacagcggcgaggagcacgccgugggcaacgacaccggcaagcacggcaaggagaucaagaucaccccccagagcagcaucaccgaggccgagcugaccggcuacggcaccgugaccauggagugcagccccagaaccggccuggacuucaacgagauggugcugcugcagauggaggagaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagaucgugaaggagaucgccgagacccagcacggcaccaucgugaucagagugcaguacgagggcgacggcagccccugcaagauccccuucgagaucauggaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcguggugacccuguaccugggcgccauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucagcaccaacaucuggcugaagcugagagagaagcaggacguguucugcgacagcaagcugaugagcgccgccaucaaggacaacagagccgugcacgccgacaugggcuacuggaucgagagcgcccugaacgacaccuggaagauggagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcaagcuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccaugcugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugauggccaccaucggcaucgcccugcugagccagagcaccauccccgagaccauccuggagcugaccgacgcccuggcccugggcaugauggugcugaagaucgugagaaacauggagaacuaccagcuggccgugaccaucauggccaucagcugcgugcccaacgccgugauccugcugaacgccuggaaggugagcugcaccauccuggccgccgugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccgugauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugaagugggaggaccacgccgagaucagcggcagcagccccauccugagcaucaccaucagcgaggacggcagcaugagcaucaagaacgaggaggaggagcagacccugaccauccugaucagaaccggccugcuggugaucagcggcguguuccccgugagcauccccaucaccgccgccgccugguaccugugggaggugaagaagcagagagccggcgugcugugggacgugcccagccccccccccgugggcaaggccgagcuggaggacggcgccuacagaaucaagcagagaggcauccugggcuacagccagaucggcgccggcguguacaaggagggcaccuuccacaccauguggcacgugaccagaggcgccgugcugaugcacagaggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucguggacagaaagggcaagguggugggccuguacggcaacggcguggugaccagaagcggcgccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagagccaacgacugggacuucguggugaccaccgacaucagcgagaugggcgccaacuucagagccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacagaguggccgccgagggcaucaacuacgccgacagaagauggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagagacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucaccacccaggagagcgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggagcccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccaucgaggccggcagaacccugagagugcugaaccugguggagaacuggcugaacaacaacacccaguucugcaucaaggugcugaaccccuacaugcccagcgugaucgagaagauggagacccugcagagaaaguacggcggcgcccuggugagaaacccccugagcagaaacagcacccacgagauguacugggugagcaacgccaccggcaacaucgugagcagcgugaacaugaucagcagaaugcugaucaacagauucaccaugaagcacaagaaggccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacguggugcccauggugacccagauggccaugaccgacaccacccccuucggccagcagagaguguucaaggagaagguggacaccagaacccaggagcccaaggagggcaccaagaagcugaugagaaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcagauucugggagcugguggacagagagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagaggcaacagccugagcggcguggagggcgagggccugcacagacugggcuacauccugagagacgugagcaagaaggagggcggcgccauguacgccgacgacaccgccggcugggacaccagaaucacccuggaggaccugaagaacgaggagauggugaccaaccacaugaagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcaucuucaagagcauccagcaccugaccgugaccgaggagaucgccgugcagaacuggcuggccagagugggcagagagagacugagcagaauggccaucagcggcgacgacugcguggugaagccccuggacgacagauucgccagcgcccugaccgcccugaacgacaugggcaaggugagaaaggacauccagcagugggagcccagcagaggcuggaacgacuggacccaggugcccuucugcagccaccacuuccacgagcuggugaugaaggacggcagagugcugguggugcccugcagaaaccaggacgagcugaucggcagagccagaaucagccagggcgccggcuggagccugaaggagaccgccugccugggcaagagcuacgcccagauguggacccugauguacuuccacagaagagaccugagacuggccgccaacgccaucugcagcgccgugcccagccacugggugcccaccagcagaaccaccuggagcauccacgccaagcacgaguggaugaccaccgaggacaugcuggccguguggaacagaguguggauccaggagaaccccuggauggaggacaagacccccguggagagcugggaggaggugcccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 17392 - RNA, 9876 nt, Artificial Sequence
  derived and/or modified CDS sequence (opt4) from DENV-2__FJ898466__SS-prME
accgccggcgugaucgugaugcugauccccaccgccauggccuuccaccugaccaccagaaacggcgagccccacaugaucgugggcagacaggagaagggcaagagccugcuguucaagaccgaggacggcgugaacaugugcacccugauggccaucgaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgugcagagaaucgagaccuggauccugagacaccccggcuucaccaucauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaacgaggagcaggacaagagauucaucugcaagcacagcaugguggacagaggcuggggcaacggcugcggccuguucggcaagggcggcaucgugaccugcgccauguucaccugcaagaagaacauggagggcaagguggugcagcccgagaaccuggaguacaccaucgugaucaccccccacagcggcgaggagcacgccgugggcaacgacaccggcaagcacggcaaggagaucaagaucaccccccagagcagcaucaccgaggccgagcugaccggcuacggcaccgugaccauggagugcagccccagaaccggccuggacuucaacgagauggugcugcugcagauggaggacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagaucgugaaggagaucgccgagacccagcacggcaccaucgugaucagagugcaguacgagggcgacggcagccccugcaagauccccuucgagaucaccgaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcguggugacccuguaccugggcgccauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagagagcccacgaggagggcaucugcggcaucagaagcgugaccagacuggagaaccugauguggaagcagaucacccccgagcugaaccacauccugagcgagaacgaggugaagcugaccaucaugaccggcgacaccaagggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucaccaccaacaucuggcugaagcugagagagaagcaggacaucuucugcgacagcaagcugaugagcgccgccaucaaggacaacagagccgugcacgccgacaugggcuacuggaucgagagcgcccugaacgacaccuggaagauggagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcaagcuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugauggccaccaucggcaucgcccugcugagccagagcaccauccccgagaccauccuggagcugaccgacgcccuggcccugggcaugauggcccugaagaucgugagaaacauggagaaguaccagcuggccgugaccaucauggccaucagcugcgugcccaacgccgugauccugcagaacgccuggaaggugagcugcaccauccuggccgccgugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggcguguuccccgugagcauccccaucaccgccgccgccugguaccugugggaggugaagaagcagagagccggcgugcugugggacgugcccagccccccccccgugggcaaggccgagcuggaggacggcgccuacagaaucaagcagagaggcauccugggcuacagccagaucggcgccggcguguacaaggagggcaccuuccacaccauguggcacgugaccagaggcgccgugcugaugcacagaggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggcaucuucagaaccaacaccggcaccaucggcgccgugagccuggacuucagccccggcaccagcggcagccccaucguggacagaaagggcaagguggugggccuguacggcaacggcguggugaccagaagcggcgccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucaaggccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagagccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaaaguggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagaaacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucaccacccaggagagcgagagcaacauccuggacaucgaccugagacccgccagcgccuggacccuguacgccguggccaccaccuucaucacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggagcccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccaucgaggccggcagaacccugagagugcugaaccugguggagaacuggcugaacaacaacacccaguucugcaucaaggugcugaaccccuacaugcccagcgugaucgagaagauggagacccugcagagaaaguacggcggcgcccuggugagaaacccccugagcagaaacagcacccacgagauguacugggugagcaacgccaccggcaacaucgugagcagcgugaacaugaucagcagaaugcugaucaacagauucaccaugaagcacaagaaggccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacguggugcccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagagaaagacccccagaaugugcaccagagaggaguucaccaagaaggugagaagcaacgccgcccugggcgccaucuucaccgacgagaacaaguggaagagcgccagagaggccguggaggacggcagauucugggagcugguggacagagagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagaggcaacagccugagcggcguggagggcgagggccugcacagacugggcuacauccugagagacgugggcaagaaggagggcggcgccauguacgccgacgacaccgccggcugggacaccagaaucacccuggaggaccugaagaacgaggagauggugaccaaccacaugaagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcaucuucaagagcauccagcaccugaccgccaccgaggagaucgccgugcagaacuggcuggccagagugggcagagagagacugagcagaauggccaucagcggcgacgacugcguggugaagcccaucgacgacagauucgccagcgcccugaccgcccugaacgacaugggcaaggugagaaaggacauccagcagugggagcccagcagaggcuggaacgacuggacccaggugcccuucugcagccaccacuuccacgagcuggugaugaaggacggcagagugcugguggugcccugcagaagccaggacgagcugaucggcagagccagaaucagccagggcgccggcuggagccugaaggagaccgccugccugggcaagagcuacgcccagauguggacccugauguacuuccacagaagagaccugagacuggccgccaacgccaucugcagcgccgugcccagccacugggugcccaccagcagaaccaccuggagcauccacgccaagcacgaguggaugaccaccgaggacaugcuggccguguggaacagaguguggauccaggagaaccccuggauggaggacaagacccccguggagagcugggaggaggugcccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 17393 - RNA, 9876 nt, Artificial Sequence
  derived and/or modified CDS sequence (opt4) from DENV-2__FJ898467__SS-prME
accgccggcgugaucaucaugcugauccccaccgccauggccuuccaccugaccaccagaaacggcgagccccacaugaucgugggcagacaggagaagggcaagagccugcuguucaagaccgaggacggcgugaacaugugcacccugauggccaucgaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgugcagagaaucgagaccuggauccugagacaccccggcuucaccaucauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaacgaggagcaggacaagagauucaucugcaagcacagcaugguggacagaggcuggggcaacggcugcggccuguucggcaagggcggcaucgugaccugcgccauguucaccugcaagaagaacauggagggcaagguggugcagcccgagaaccuggaguacaccaucgugaucaccccccacagcggcgaggagcacgccgugggcaacgacaccggcaagcacggcaaggagaucaagaucaccccccagagcagcaucaccgaggccgagcugaccggcuacggcaccgugaccauggagugcagccccagaaccggccuggacuucaacgagauggugcugcugcagauggaggacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagaucgugaaggagaucgccgagacccagcacggcaccaucgugaucagaauccaguacgagggcgacggcagccccugcaagauccccuucgagaucaccgaccuggagaagagacacgugcugggcagacugaucaccgugaaccccaucgugaucgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcguggugaucaccuggaucggcaugaacagcagaagcaccagccugagcgugagccuggugcuggugggcguggugacccuguaccugggcgccauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaccaagggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucaccaccaacaucuggcugaagcugagagagaagcaggacguguucugcgacagcaagcugaugagcgccgccaucaaggacaacagagccgugcacgccgacaugggcuacuggaucgagagcgcccugaacgacaccuggaagauggagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcaagcuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugauggccaccaucggcaucacccugcugagccagagcaccauccccgagaccauccuggagcugaccgacgcccuggcccugggcaugauggugcugaagaucgugagaaacauggagaaguaccagcuggccgugaccaucauggccaucagcugcgugcccaacgccgugauccugagaaacgccuggaaggugagcugcaccauccuggccgccgugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggcguguuccccgugagcauccccaucaccgccgccgccugguaccugugggaggugaagaagcagagagccggcgugcugugggacgugcccagccccccccccgugggcaaggccgagcuggaggacggcgccuacagaaucaagcagagaggcauccugggcuacagccagaucggcgccggcguguacaaggagggcaccuuccacaccauguggcacgugaccagaggcgccgugcugaugcacagaggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggcaucuucaagaccaacaccggcaccaucggcgccgugagccuggacuucagccccggcaccagcggcagccccaucguggacagaaagggcaagguggugggccuguacggcaacggcguggugaccagaagcggcgccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucaaggccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagagccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaaaguggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagaaacgcccuggacaaccuggccgugcugcacaccgccgaggccggcggcaaggccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcgugcugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucaccacccaggagagcgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggagcccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccaucgaggccggcagaacccugagagugcugaaccugguggagaacuggcugaacaacaacacccaguucugcaucaaggugcugaaccccuacaugcccagcgugaucgagaagauggagacccugcagagaaaguacggcggcgcccuggugagaaacccccugagcagaaacagcacccacgagauguacugggugagcaacgccaccggcaacaucgugagcagcgugaacaugaucagcagaaugcugaucaacagauucaccaugaagcacaagaaggccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacguggugcccauggugacccagauggccaugaccgacaccacccccuucggccagcagagaguguucaaggagaagguggacaccagaacccaggagcccaaggagggcaccaagaagcugaugagaaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacggcagauucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagaggcaacagccugagcggcguggagggcgagggccugcacagacugggcuacauccugagagacgugggcaagaaggagggcggcgccauguacgccgacgacaccgccggcugggacaccagaaucacccuggaggaccugaagaacgaggagauggugaccaaccacaugaagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcaucuucaagagcauccagcaccugaccgccaccgaggagaucgccgugcagaacuggcuggccagagugggcagagagagacugagcagaauggccaucagcggcgacgacugcguggugaagcccaucgacgacagauucgccagcgcccugaccgcccugaacgacaugggcaaggugagaaaggacauccagcagugggagcccagcagaggcuggaacgacuggacccaggugcccuucugcagccaccacuuccacgagcuggugaugaaggacggcagagugcugguggugcccugcagaaaccaggacgagcugaucggcagagccagaaucagccagggcgccggcuggagccugaaggagaccgccugccugggcaagagcuacgcccagauguggacccugauguacuuccacagaagagaccugagacuggccgccaacgccaucugcagcgccgugcccagccacugggugcccaccagcagaaccaccuggagcauccacgccaagcacgaguggaugaccaccgaggacaugcuggccguguggaacagaguguggauccaggagaaccccuggauggaggacaagacccccguggagagcugggaggaggugcccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 17394 - RNA, 9876 nt, Artificial Sequence
  derived and/or modified CDS sequence (opt4) from DENV-2__GQ868595__SS-prME
accgccggcgugaucaucaugcugauccccaccgccauggccuuccaccugaccaccagaaacggcgagccccacaugaucgugagcagacaggagaagggcaagagccugcuguucaagaccgaggacggcgugaacaugugcacccugauggccaucgaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgugcagagaaucgagaccuggauccugagacaccccggcuucgccaucauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaacgaggagcaggacaagagauucaucugcaagcacagcaugguggacagaggcuggggcaacggcugcggccuguucggcaagggcggcaucgugaccugcgccauguucaccugcaagaagaacauggagggcaagguggugcugcccgagaaccuggaguacaccaucgugaucaccccccacagcggcgaggagcacgccgugggcaacgacaccggcaagcacggcaaggagaucaagaucaccccccagagcagcaucaccgaggccgagcugaccggcuacggcaccgugaccauggagugcagccccagaaccggccuggacuucaacgagauggugcugcugcagauggaggagaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagaucgugaaggagaucgccgagacccagcacggcaccaucgugaucagagugcaguacgagggcgacggcagccccugcaagauccccuucgagaucauggaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcguggugacccuguaccugggcgccauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucaccaccaacaucuggcugaagcugagagagaagcaggacguguucugcgacagcaagcugaugagcgccgccaucaaggacaacagagccgugcacgccgacaugggcuacuggaucgagagcgcccugaacgacaccuggaagauggagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcaagcuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugauggccaccaucggcaucgcccugcugagccagagcaccauccccgagaccauccuggagcugaccgacgcccuggcccugggcaugauggugcugaagaucgugagaaacauggagaaguaccagcuggccgugaccaucauggccaucagcugcgugcccaacgccgugauccugcugaacgccuggaaggugagcugcaccauccuggccgccgugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccgugauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggcguguuccccgugagcauccccaucaccgccgccgccugguaccugugggaggugaagaagcagagagccggcgugcugugggacgugcccagccccccccccgugggcaaggccgagcuggaggacggcgccuacagaaucaagcagagaggcauccugggcuacagccagaucggcgccggcguguacaaggagggcaccuuccacaccauguggcacgugaccagaggcgccgugcugaugcacagaggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucguggacagaaagggcaagguggugggccuguacggcaacggcguggugaccagaagcggcgccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagagccaacgacugggacuucguggugaccaccgacaucagcgagaugggcgccaacuucagagccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacagaguggccgccgagggcaucaacuacgccgacagaagauggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagagacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucaccacccaggagagcgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggagcccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccaucgaggccggcagaacccugagagugcugaaccugguggagaacuggcugaacaacaacacccaguucugcaucaaggugcugaaccccuacaugcccagcgugaucgagaagauggagacccugcagagaaaguacggcggcgcccuggugagaaacccccugagcagaaacagcacccacgagauguacugggugagcaacgccaccggcaacaucgugagcagcgugaacaugaucagcagaaugcugaucaacagauucaccaugaagcacaagaaggccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacguggugcccauggugacccagauggccaugaccgacaccacccccuucggccagcagagaguguucaaggagaagguggacaccagaacccaggagcccaaggagggcaccaagaagcugaugagaaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcagauucugggagcugguggacagagagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagaggcaacagccugagcggcguggagggcgagggccugcacagacugggcuacauccugagagacgugagcaagaaggagggcggcgccauguacgccgacgacaccgccggcugggacaccagaaucacccuggaggaccugaagaacgaggagauggugaccaaccacaugagaggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcaucuucaagagcaucaagcaccugaccgugaccgaggagaucgccgugcagaacuggcuggccagagugggcagagagagacugagcagaauggccaucagcggcgacgacugcguggugaagccccuggacgacagauucgccagcgcccugaccgcccugaacgacaugggcaaggugagaaaggacauccagcagugggagcccagcagaggcuggaacgacuggacccaggugcccuucugcagccaccacuuccacgagcuggugaugaaggacggcagagugcugguggugcccugcagaaaccaggacgagcugaucggcagagccagaaucagccagggcgccggcuggagccugaaggagaccgccugccugggcaagagcuacgcccagauguggacccugauguacuuccacagaagagaccugagacuggccgccaacgccaucugcagcgccgugcccagccacugggugcccaccagcagaaccaccuggagcauccacgccaagcacgaguggaugaccaccgaggacaugcuggccguguggaacagaguguggauccaggagaaccccuggauggaggacaagacccccguggagagcugggaggaggugcccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 17395 - RNA, 9876 nt, Artificial Sequence
  derived and/or modified CDS sequence (opt4) from DENV-2__GQ868540__SS-prME
accgccggcgugaucaucaugcugauccccaccgccauggccuuccaccugaccaccagaaacggcgagccccacaugaucgugggcagacaggagaagggcaagagccugcuguucaagaccgaggacggcgugaacaugugcacccugauggccaucgaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgugcagagaaucgagaccuggauccugagacaccccggcuucgccaucauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaacgaggagcaggacaagagauucaucugcaagcacagcaugguggacagaggcuggggcaacggcugcggccuguucggcaagggcggcaucgugaccugcgccauguucaccugcaagaagaacauggagggcaagguggugcugcccgagaaccuggaguacaccaucgugaucaccccccacagcggcgaggagcacgccgugggcaacgacaccggcaagcacggcaaggagaucaagaucaccccccagagcagcaucaccgaggccgagcugaccggcuacggcaccgugaccauggagugcagccccagaaccggccuggacuucaacgagauggugcugcugcagauggaggagaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagaucgugaaggagaucgccgagacccagcacggcaccaucgugaucagagugcaguacgagggcgacggcagccccugcaagauccccuucgagaucauggaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcguggugacccuguaccugggcgccauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagccacaaccagaccuuccugguggacggccccgagaccgccgagugccccaacaccaacagagccuggaacagccuggagguggaggacuacggcuucggcguguucaccaccaacaucuggcugaagcugagagagaagcaggacguguucugcgacagcaagcugaugagcgccgccaucaaggacaacagagccgugcacgccgacaugggcuacuggaucgagagcgcccugaacgacaccuggaagauggagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcaagcuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugauggccaccaucggcaucgcccugcugagccagagcaccauccccgagaccauccuggagcugaccgacgcccuggcccugggcaugauggugcugaagaucgugagaaacauggagaaguaccagcuggccgugaccaucauggccaucagcugcgugcccaacgccgugauccugcugaacgccuggaaggugagcugcaccauccuggccgccgugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccgugauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggcguguuccccgugagcauccccaucaccgccgccgccugguaccugugggaggugaagaagcagagagccggcgugcugugggacgugcccagccccccccccgugggcaaggccgagcuggaggacggcgccuacagaaucaagcagagaggcauccugggcuacagccagaucggcgccggcguguacaaggagggcaccuuccacaccauguggcacgugaccagaggcgccgugcugaugcacagaggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucguggacagaaagggcaagguggugggccuguacggcaacggcguggugaccagaagcggcgccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagagccaacgacugggacuucguggugaccaccgacaucagcgagaugggcgccaacuucagagccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacagaguggccgccgagggcaucaacuacgccgacagaagauggugcuucgacggcaucaagaacaaccagauccuggaggagaacauggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagagacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucaccacccaggagagcgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggagcccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccaucgaggccggcagaacccugagagugcugaaccugguggagaacuggcugaacaacaacacccaguucugcaucaaggugcugaaccccuacaugcccagcgugaucgagaagauggagacccugcagagaaaguacggcggcgcccuggugagaaacccccugagcagaaacagcacccacgagauguacugggugagcaacgccaccggcaacaucgugagcagcgugaacaugaucagcagaaugcugaucaacagauucaccaugaagcacaagaaggccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacguggugcccauggugacccagauggccaugaccgacaccacccccuucggccagcagagaguguucaaggagaagguggacaccagaacccaggagcccaaggagggcaccaagaagcugaugagaaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcagauucugggagcugguggacagagagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagaggcaacagccugagcggcguggagggcgagggccugcacagacugggcuacauccugagagacgugagcaagaaggagggcggcgccauguacgccgacgacaccgccggcugggacaccagaaucacccuggaggaccugaagaacgaggagauggugaccaaccacaugaagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcaucuucaagagcauccagcaccugaccgugaccgaggagaucgccgugcagaacuggcuggccagagugggcagagagagacugagcagaauggccaucagcggcgacgacugcguggugaagccccuggacgacagauucgccagcgcccugaccgcccugaacgacaugggcaaggugagaaaggacauccagcagugggagcccagcagaggcuggaacgacuggacccaggugcccuucugcagccaccacuuccacgagcuggugaugaaggacggcagagugcugguggugcccugcagaaaccaggacgagcugaucggcagagccagaaucagccagggcgccggcuggagccugaaggagaccgccugccugggcaagagcuacgcccagauguggacccugauguacuuccacagaagagaccugagacuggccgccaacgccaucugcagcgccgugcccagccacugggugcccaccagcagaaccaccuggagcauccacgccaagcacgaguggaugaccaccgaggacaugcuggccguguggaacagaguguggauccaggagaaccccuggauggaggacaagacccccguggagagcugggaggagauccccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 17396 - RNA, 9876 nt, Artificial Sequence
  derived and/or modified CDS sequence (opt4) from DENV-2__GQ868541__SS-prME
accgccggcgugaucaucaugcugauccccaccgccauggccuuccaccugaccaccagaaacggcgagccccacaugaucgugggcagacaggagaagggcaagagccugcuguucaagaccgaggacggcgugaacaugugcacccugauggccaucgaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgugcagagaaucgagaccuggauccugagacaccccggcuucgccaucauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaacgaggagcaggacaagagauucaucugcaagcacagcaugguggacagaggcuggggcaacggcugcggccuguucggcaagggcggcaucgugaccugcgccauguucaccugcaagaagaacauggagggcaagguggugcugcccgagaaccuggaguacaccaucgugaucaccccccacagcggcgaggagcacgccgugggcaacgacaccggcaagcacggcaaggagaucaagaucaccccccagagcagcaucaccgaggccgagcugaccggcuacggcaccgugaccauggagugcagccccagaaccggccuggacuucaacgagauggugcugcugcagauggaggagaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagaucgugaaggagaucgccgagacccagcacggcaccaucgugaucagagugcaguacgagggcgacggcagccccugcaagauccccuucgagaucauggaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcguggugacccuguaccugggcgccauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucaccaccaacaucuggcugaagcugagagagaagcaggacguguucugcgacagcaagcugaugagcgccgccaucaaggacaacagagccgugcacgccgacaugggcuacuggaucgagagcgcccugaacgacaccuggaagauggagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcaagcuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugauggccaccaucggcaucgcccugcugagccagagcaccauccccgagaccauccuggagcugaccgacgcccuggcccugggcaugauggugcugaagaucgugagaaacauggagaaguaccagcuggccgugaccaucauggccaucagcugcgugcccaacgccgugauccugcugaacgccuggaaggugagcugcaccauccuggccgccgugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccgugauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugaagugggaggaccacgccgagaucagcggcagcagccccauccugagcaucaccaucagcgaggacggcagcaugagcaucaagaacgaggaggaggagcagacccugaccauccugaucagaaccggccugcuggugaucagcggcguguuccccgugagcauccccaucaccgccgccgccugguaccugugggaggugaagaagcagagagccggcgugcugugggacgugcccagccccccccccgugggcaaggccgagcuggaggacggcgccuacagaaucaagcagagaggcauccugggcuacagccagaucggcgccggcguguacaaggagggcaccuuccacaccauguggcacgugaccagaggcgccgugcugaugcacagaggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucguggacagaaagggcaagguggugggccuguacggcaacggcguggugaccagaagcggcgccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagagccaacgacugggacuucguggugaccaccgacaucagcgagaugggcgccaacuucagagccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacagaguggccgccgagggcaucaacuacgccgacagaagauggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagagacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucaccacccaggagagcgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggagcccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccaucgaggccggcagaacccugagagugcugaaccugguggagaacuggcugaacaacaacacccaguucugcaucaaggugcugaaccccuacaugcccagcgugaucgagaagauggagacccugcagagaaaguacggcggcgcccuggugagaaacccccugagcagaaacagcacccacgagauguacugggugagcaacgccaccggcaacaucgugagcagcgugaacaugaucagcagaaugcugaucaacagauucaccaugaagcacaagaaggccaccuacgagcccgacguggaccugggcagcggcaccagaaacaucggcaucgagagcgagauccccaaccuggacaucaucggcaagagaaucgagaagaucaagcaggagcacgagaccagcuggcaccacgaccaggaccaccccuacaagaccugggccuaccacggcagcuacgagaccaagcagaccggcagcgccagcagcauggugaacggcguggugagacugcugaccaagcccugggacguggugcccauggugacccagauggccaugaccgacaccacccccuucggccagcagagaguguucaaggagaagguggacaccagaacccaggagcccaaggagggcaccaagaagcugaugagaaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcagauucugggagcugguggacagagagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagaggcaacagccugagcggcguggagggcgagggccugcacagacugggcuacauccugagagacgugagcaagaaggagggcggcgccauguacgccgacgacaccgccggcugggacaccagaaucacccuggaggaccugaagaacgaggagauggugaccaaccacaugaagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcaucuucaagagcauccagcaccugaccgugaccgaggagaucgccgugcagaacuggcuggccagagugggcagagagagacugagcagaauggccaucagcggcgacgacugcguggugaagccccuggacgacagauucgccagcgcccugaccgcccugaacgacaugggcaaggugagaaaggacauccagcagugggagcccagcagaggcuggaacgacuggacccaggugcccuucugcagccaccacuuccacgagcuggugaugaaggacggcagagugcugguggugcccugcagaaaccaggacgagcugaucggcagagccagaaucagccagggcgccggcuggagccugaaggagaccgccugccugggcaagagcuacgcccagauguggacccugauguacuuccacagaagagaccugagacuggccgccaacgccaucugcagcgccgugcccagccacugggugcccaccagcagaaccaccuggagcauccacgccaagcacgaguggaugaccaccgaggacaugcuggccguguggaacagaguguggauccaggagaaccccuggauggaggacaagacccccguggagagcugggaggaggugcccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 17397 - RNA, 9876 nt, Artificial Sequence
  derived and/or modified CDS sequence (opt4) from DENV-2__GQ868603__SS-prME
accgccggcgugaucaucaugcugauccccaccgccauggccuuccaccugaccaccagaaacggcgagccccacaugaucgugggcagacaggagaagggcaagagccugcuguucaagaccgaggacggcgugaacaugugcacccugauggccaucgaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgugcagagaaucgagaccuggauccugagacaccccggcuucaccaucauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaacgaggagcaggacaagagauuccugugcaagcacagcaugguggacagaggcuggggcaacggcugcggccuguucggcaagggcggcaucgugaccugcgccauguucaccugcaagaagaacauggagggcaagguggugcugcccgagaaccuggaguacaccaucgugaucaccccccacagcggcgaggagcacgccgugggcaacgacaccggcaagcacggcaaggagaucaagaucaccccccagagcagcaucaccgaggccgagcugaccggcuacggcaccgugaccauggagugcagccccagaaccggccuggacuucaacgagauggugcugcugcagauggaggacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagaucgugaaggagaucgccgagacccagcacggcaccaucgugaucagagugcaguacgagggcgacggcagccccugcaagauccccuucgagaucauggaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcguggugacccuguaccugggcgccauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucaccaccaacaucuggcugaagcugagagagaagcaggacgugcugugcgacagcaagcugaugagcgccgccaucaaggacaacagagccgugcacgccgacaugggcuacuggaucgagagcgcccugaacgacaccuggaagauggagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcaagcuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcuggccgccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugauggccaccaucggcaucgcccugcugagccagagcaccauccccgagaccauccuggagcugaccgacgcccuggcccugggcaugauggugcugaagaucgugagaaacauggagaaguaccagcugguggugaccaucauggccaucagcugcgugcccaacgccgugauccugcagaacgccuggaaggugagcugcaccauccuggccgccgugagcgugagcccccugcugcugaccagcagcagacagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggcguguuccccgugagcauccccaucaccgccgccgccugguaccugugggaggugaagaagcagagagccggcgugcugugggacgugcccagccccccccccgugggcaaggccgagcuggaggacggcgccuacagaaucaagcagagaggcauccugggcuacagccagaucggcgccggcguguacaaggagggcaccuuccacaccauguggcacgugaccagaggcgccgugcugaugcacagaggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucguggacagaaagggcaagguggugggccuguacggcaacggcguggugaccagaagcggcgccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagagccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacagaguggccgccgagggcaucaacuacgccgacagaagauggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagagacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcgugggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucaccacccaggagagcgagagcaacauccuggacaucgaccugagacccgccagcgccuggacccuguacgccguggccaccaccuucuucacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggagcccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccaucgaggccggcagaacccugagagugcugaaccugguggagaacuggcugaacaacaacacccaguucugcaucaaggugcugaaccccuacaugcccagcgugaucgagaagauggagacccugcagagaaaguacggcggcgcccuggugagaaacccccugagcagaaacagcacccacgagauguacugggugagcaacgccaccggcaacaucgugagcagcgugaacaugaucagcagaaugcugaucaacagauucaccaugaagcacaagaaggccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacguggugcccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagauccccagaaugugcaccagagaggaguucaccagaaaggugagaagcaacgccgcccugggcgccaucuucaccgacgagaacaaguggaagagcgccagagaggccguggaggacagcagauucugggagcugguggacagagagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagaggcaacagccugagcggcguggagggcgagggccugcacagacugggcuacauccugagagacgugagcaagaaggagggcggcgccauguacgccgacgacaccgccggcugggacaccagaaucacccuggaggaccugaagaacgaggagauggugaccaaccacaugaagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcaucuucaagagcauccagcaccugaccgugaccgaggagaucgccgugcagaacuggcuggccagagugggcagagagagacugagcagaauggccaucagcggcgacgacugcguggugaagccccuggacgacagauucgccagcgcccugaccgcccugaacgacaugggcaaggugagaaaggacauccagcagugggagcccagcagaggcuggaacgacuggacccaggugcccuucugcagccaccacuuccacgagcuggugaugaaggacggcagagugcugguggugcccugcagaaaccaggacgagcugaucggcagagccagaaucagccagggcgccggcuggagccugaaggagaccgccugccugggcaagagcuacgcccagauguggacccugauguacuuccacagaagagaccugagacuggccgccaacgccaucugcagcgccgugcccagccacugggugcccaccagcagaaccaccuggagcauccacgccaagcacgaguggaugaccaccgaggacaugcuggccguguggaacagaguguggauccaggagaaccccuggauggaggacaagacccccguggagagcugggaggaggugcccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 17398 - RNA, 9876 nt, Artificial Sequence
  derived and/or modified CDS sequence (opt4) from DENV-2__FJ898450__SS-prME
accgccggcgugaucaucaugcugauccccaccgccauggccuuccaccugaccaccagaaacggcgagccccacaugaucgugggcagacaggagaagggcaagagccugcuguucaagaccgaggacggcgugaacaugugcacccugauggccaucgaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgugcagagaaucgagaccuggauccugagacaccccggcuucaccaucauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaacgaggagcaggacaagagauucaucugcaagcacagcaugguggacagaggcuggggcaacggcugcggccuguucggcaagggcggcaucgugaccugcgccauguucaccugcaagaagaacauggagggcaagguggugcugcccgagaaccuggaguacaccaucgugaucaccccccacagcggcgaggagcacgccgugggcaacgacaccggcaagcacggcaaggagaucaagaucaccccccagagcagcaucaccgaggccgagcugaccggcuacggcaccgugaccauggagugcagccccagaaccggccuggacuucaacgagauggugcugcugcagauggaggacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagaucgugaaggagaucgccgagacccagcacggcaccaucgugaucagagugcaguacgagggcgacggcagccccugcaagauccccuucgagaucauggaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcguggugacccuguaccugggcgccauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucaccaccaacaucuggcugaagcugagagagaagcaggacgccuucugcgacagcaagcugaugagcgccgccaucaaggacaacagagccgugcacgccgacaugggcuacuggaucgagagcgcccugaacgacaccuggaagauggagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcaagcuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugauggccaccaucggcaucgcccugcugagccagagcaccauccccgagaccauccuggagcugaccgacgcccuggcccugggcaugauggugcugaagaucgugagaaacauggagaaguaccagcuggccgugaccaucauggccaucagcugcgugcccaacgccgugauccugcagaacgccuggaaggugagcugcaccauccuggccgccgugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccgugauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggcguguuccccgugagcauccccaucaccgccgccgccugguaccugugggaggugaagaagcagagagccggcgugcugugggacgugcccagccccccccccgugggcaaggccgagcuggaggacggcgccuacagaaucaagcagagaggcauccugggcuacagccagaucggcgccggcguguacaaggagggcaccuuccacaccauguggcacgugaccagaggcgccgugcugaugcacagaggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucguggacagaaagggcaagguggugggccuguacggcaacggcguggugaccagaagcggcgccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagagccaacgacugggacuucguggugaccaccgacaucagcgagaugggcgccaacuucagagccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacagaguggccgccgagggcaucaacuacgccgacagaagauggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagagacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucaccacccaggagagcgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggagcccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccaucgaggccggcagaacccugagagugcugaaccugguggagaacuggcugaacaacaacacccaguucugcaucaaggugcugaaccccuacaugcccagcgugaucgagaagauggagacccugcagagaaaguacggcggcgcccuggugagaaacccccugagcagaaacagcacccacgagauguacugggugagcaacgccaccggcaacaucgugagcagcgugaacaugaucagcagaaugcugaucaacagauucaccaugaagcacaagaaggccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacagaaccugggccuaccacggcagcuacgagaccaagcagaccggcagcgccagcagcauggugaacggcguggugagacugcugaccaagcccugggacguggugcccauggugacccagauggccaugaccgacaccacccccuucggccagcagagaguguucaaggagaagguggacaccagaacccaggagcccaaggagggcaccaagaagcugaugagaaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcagauucugggagcugguggacagagagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagaggcaacagccugagcggcguggagggcgagggccugcacagacugggcuacauccugagagacgugagcaagaaggagggcggcgccauguacgccgacgacaccgccggcugggacaccagaaucacccuggaggaccugaagaacgaggagauggugaccaaccacaugaagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcaucuucaagagcauccagcaccugaccgugaccgaggagaucgccgugcagaacuggcuggccagagugggcagagagagacugagcagaauggccaucagcggcgacgacugcguggugaagccccuggacgacagauucgccagcgcccugaccgcccugaacgacaugggcaaggugagaaaggacauccagcagugggagcccagcagaggcuggaacgacuggacccaggugcccuucugcagccaccacuuccacgagcuggugaugaaggacggcagagugcugguggugcccugcagaaaccaggacgagcugaucggcagagccagaaucagccagggcgccggcuggagccugaaggagaccgccugccugggcaagagcuacgcccagauguggacccugauguacuuccacagaagagaccugagacuggccgccaacgccaucugcagcgccgugcccagccacugggugcccaccagcagaaccaccuggagcauccacgccaagcacgaguggaugaccaccgaggacaugcuggccguguggaacagaguguggauccaggagaaccccuggauggaggacaagacccccguggagagcugggaggaggugcccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 17399 - RNA, 9876 nt, Artificial Sequence
  derived and/or modified CDS sequence (opt4) from DENV-2__FJ898453__SS-prME
accgccggcgugaucgugaugcugauccccaccgccauggccuuccaccugaccaccagaaacggcgagccccacaugaucgugggcagacaggagaagggcaagagccugcuguucaagaccgaggacggcgugaacaugugcacccugauggccaucgaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgugcagagaaucgagaccuggauccugagacaccccggcuucaccaucauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaacgaggagcaggacaagagauucaucugcaagcacagcaugguggacagaggcuggggcaacggcugcggccuguucggcaagggcggcaucgugaccugcgccauguucaccugcaagaagaacauggagggcaagaucgugcagcccgagaaccuggaguacaccaucgugaucaccccccacagcggcgaggagcacgccgugggcaacgacaccggcaagcacggcaaggagaucaagaucaccccccagagcagcaccaccgaggccgagcugaccggcuacggcaccgugaccauggagugcagccccagaaccggccuggacuucaacgagauggugcugcugcagauggaggacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagaucgugaaggagaucgccgagacccagcacggcaccaucgugaucagagugcaguacgagggcgacggcagccccugcaagauccccuucgagaucaccgaccuggagaagagacacgugcugggcagacugaucaccgugaaccccaucgugaccgagaaggacagccccgugaacaucgaggccgagccccccuucggcgacagcuacaucaucgugggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcguggugacccuguaccugggcgccauggugcaggccgacagcggcugcaucgugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucagcaccaacaucuggcugaagcugagagagagacaggacguguucugcgacagcaagcugaugagcgccgccaucaaggacaacagagccgugcacgccgacaugggcuacuggaucgagagcgcccugaacgacaccuggaagauggagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcaagcuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugguggcccugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugauggccaccaucggcaucgcccugcugagccagagcacccugcccgagaccauccuggagcugaccgacgcccuggcccugggcaugauggugcugaagaucgugagaaacauggagaaguaccagcuggccgugaccaucauggccaucagcugcgugcccaacgccgugauccugcagaacgccuggaaggugagcugcaccauccuggccgccgugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggcguguuccccgugagcauccccaucaccgccgccgccugguaccugugggaggugaagaagcagagagccggcgugcugugggacgugcccagccccccccccgugggcaaggccgagcuggaggacggcguguacagaaucaagcagagaggcauccugggcuacagccagaucggcgccggcguguacaaggagggcaccuuccacaccauguggcacgugaccagaggcgccgugcugaugcacagaggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggcaucuucaagaccaacaccggcaccaucggcgccgugagccuggacuucagccccggcaccagcggcagccccaucguggacagaaagggcaagguggugggccuguacggcaacggcguggugaccagaagcggcgccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagagccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaaaguggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagaaacgcccuggacaaccuggccgugcugcacaccgccgaggugggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggcuucggcagcaucaccacccaggagagcgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggagcccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacgugggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacaugguggcccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccaucgaggccggcagaacccugagagugcugaaccugguggagaacuggcugaacaacaacacccaguucugcaucaaggugcugaaccccuacaugcccagcgugaucgagaagauggagacccugcagagaaaguacggcggcgcccuggugagaaacccccugagcagaaacagcacccacgagauguacugggugagcaacgccaccggcaacaucgugagcagcgugaacaugaucagcagaaugcugaucaacagauucaccaugaagcacaagaaggccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacguggugcccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaaggagaagacccccagaaugugcaccagagaggaguucaccagaaaggugagaagcaacgccgcccugggcgccaucuucaccgacgagaacaaguggaagagcgccagagaggccguggaggacggcagauucugggagcugguggacagagagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagaggcaacagccugagcggcguggagggcgagggccugcacagacugggcuacauccugagagaggugggcaagaaggagggcggcgccauguacgccgacgacaccgccggcugggacaccagaaucacccuggaggaccugaagaacgaggagauggugaccaaccacaugaagggcgagcacaagaagcuggccgaggccaucuucaagcugaccuaccagaacaagguggugagagugcagagacccacccccagaggcaccgugauggacaucaucagcagaaaggaccagagaggcagcggccaggugggcaccuacggccugaacaccuucaccaacauggaggcccagcugaucagacagauggagggcgagggcaucuucaagagcauccagcaccugaccgugaccgaggagaucgccgugcagaacuggcuggccagagugggcagagagagacugagcagaauggccaucagcggcgacgacugcguggugaagcccaucgacgacagauucgccagcgcccugaccgcccugaacgacaugggcaaggugagaaaggacauccagcagugggagcccagcagaggcuggaacgacuggacccaggugcccuucugcagccaccacuuccacgagcuggugaugaaggacggcagagugcugguggugcccugcagaaaccaggacgagcugaucggcagagccagaaucagccagggcgccggcuggagccugaaggagaccgccugccugggcaagagcuacgcccagauguggacccugauguacuuccacagaagagaccugagacuggccgccaacgccaucugcagcgccgugcccagccacugggugcccaccagcagaaccaccuggagcauccacgccaagcacgaguggaugaccaccgaggacaugcuggccguguggaacagaguguggauccaggagaaccccuggauggaggacaagacccccguggagagcugggaggaggugcccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 17400 - RNA, 9876 nt, Artificial Sequence
  derived and/or modified CDS sequence (opt4) from DENV-2__EU482445__SS-prME
agcgccggcaugaucaucaugcugauccccaccgugauggccuuccaccugaccaccagaaacggcgagccccacaugaucgugggcauccaggagaagggcaagagccugcuguucaagaccgaggacggcgugaacaugugcacccugauggccauggaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgcccagagaaucgagaccuggauccugagacaccccggcuucaccaucauggccgccauccuggccuacaccaucggcaccacccacuuccagagagugcugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaaggaggagcaggacaagagauucgugugcaagcacagcaugguggacagaggcuggggcaacggcugcggccuguucggcaagggcggcaucgugaccugcgccauguucaccugcaagaagaacauggagggcaagaucgugcagcccgagaaccuggaguacaccaucguggugaccccccacagcggcgaggagcacgccgugggcaacgacaccggcaagcacggcaaggagaucaaggugaccccccagagcagcaucaccgaggccgagcugaccggcuacggcaccgugaccauggagugcagccccagaaccggccuggacuucaacgagauggugcugcugcagauggagaacaaggccuggcuggugcacagacagugguuccuggaccugccccugcccuggcugcccggcgccgacaagcaggagagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucgugaucagagugcaguacgagggcgacggcagccccugcaagauccccuucgagaucauggaccuggagaagagauacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggacccugaagauccugaucggcgugaucaucaccuggaucggcaugaacagcagaagcaccagccugagcgugagccuggugcuggugggcaucgugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccaggaggagggcaucugcggcaucagaagcgugaccagacuggagaaccugauguggaagcagaucacccccgagcugaaccacauccuggccgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagcuacaaccagaccuuccugaucgacggccccgagaccaccgagugccccaacaccaacagagccuggaacagccuggagguggaggacuacggcuucggcguguucaccaccaacaucuggcugaagcugaaggagaagcaggacgccuucugcgacagcaagcugaugagcgccgccaucaaggacaacagagccgugcacgccgacaugggcuacuggaucgagagcgcccugaacgacaccuggaagaucgagaaggccagcuucaucgaggugaagaacugccacuggcccaagagccacacccuguggagcaacggcgugcuggagagcgagaugaucauccccaagaaccuggccggccccgugagccagcacaacuacagacccggcuaccacacccagaucgccggccccuggcaccugggcaagcuggagauggacuucgacuucugcgacggcaccaccgugaucgugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagguggacaacuucagccugggcgugcugggcauggcccuguuccuggaggagaugcugagaaccagagugggcaccaagcacgccauccugcugguggccgugagcuucgugacccugaucaccggcaacaugagcuucaaggaccugggcagagugguggugauggugggcgccaccauggccgacgacaucggcaugggcgugaccuaccuggcccugcuggccgccuucaaggugagacccaccuucgccgccggccugcugcugagaaagcugaccagcaaggagcugaugaugaccaccaucggcaucgugcugcugagccagagcaccauccccgagaccgugcuggagcugaccgacgcccuggcccugggcaugauggugcugaagaucgugagaaacauggagaaguaccagcuggccgugaccaucauggccauccugugcgugcccaacgccgugauccugcagaacgccuggaaggugagcugcaccauccuggccguggugagcgugagcccccugcugcugaccagcagccagcagaagaccgacuggaucccccuggcccugaccaucaagggccugaaccccaccgccaucuuccugaccacccugagcagaaccaacaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccaccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggccuguuccccaucagcauccccaucaccgccgccgccugguaccugugggaggugaagaagcagagagccggcgugcugugggacgugcccagccccccccccaugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacaagggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucaucgacaagaagggcaagguggugggccuguacggcaacggcguggugaccagaagcggcgccuacgugagcgccaucgcccagaccgagaagagcaucgaggacaaccccgagaucgaggacgacaucuucagaaagagaagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucaucgacgaggagagagagauccccgagagaagcuggaacaccggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaagauggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaagaccagagacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcagaggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucgccacccagcagcccgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggaccccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaucccccccgagaagugcgacacccugcugugcgacaucggcgagagcagccccaaccccaccguggaggccggcagaacccugagagugcugaaccugguggagaacuggcugaacaacaacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccagcggcaacaucgugagcagcgugaacaugaucagcagaaugcugaucaacagauucaccaugagacacaagaaggccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacgugcugcccaccgugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcagauucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacauggagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcguguucaagaacauccagcaccugaccgugaccgaggagguggccgugcagaacuggcuggccagagugggcagagagagacugagcagaauggccaucagcggcgacgacugcguggugaagccccuggacgacagauucgccaacgcccugaccgcccugaacgacaugggcaagaucagaaaggacauccagcagugggagcccagcaagggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugagagagaccgccugccugggcaagagcuacgcccagauguggagccugauguacuuccacagaagagaccugagacuggccgccaacgccaucugcagcgccgugcccagccacugggugcccaccagcagaaccaccuggagcauccacgccaagcacgaguggaugaccaccgaggacaugcugaccguguggaacagaguguggaucagagagaaccccuggauggaggacaagacccccguggagagcugggaggagauccccuaccugggcaagagagaggaccaguggugcggcagccugaucggccugaccagcagagccaccugggccaagaacauccaggccgccaucaaccaggugagaagccugaucggcaacgaggaguacaccgacuacaugcccagcaugaagagauucagaagagaggaggaggaggccggcgugcugugguga

SEQ ID NO: 17401 - RNA, 9876 nt, Artificial Sequence
  derived and/or modified CDS sequence (opt4) from DENV-2__EU482446__SS-prME
agcgccggcaugaucaucaugcugauccccaccgugauggccuuccaccugaccaccagaaacggcgagccccacaugaucgugggcauccaggagaagggcaagagccugcuguucaagaccgaggacggcgugaacaugugcacccugauggccauggaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgcccagagaaucgagaccuggauccugagacaccccggcuucaccaucauggccgccauccuggccuacaccaucggcaccacccacuuccagagagugcugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaaggaggagcaggacaagagauucgugugcaagcacagcaugguggacagaggcuggggcaacggcugcggccuguucggcaagggcggcaucgugaccugcgccauguucaccugcaagaagaacauggagggcaagaucgugcagcccgagaaccuggaguacaccaucguggugaccccccacagcggcgaggagcacgccgugggcaacgacaccggcaagcacggcaaggagaucaaggugaccccccagagcagcaucaccgaggccgagcugaccggcuacggcaccgugaccauggagugcagccccagaaccggccuggacuucaacgagauggugcugcugcagauggagaacaaggccuggcuggugcacagacagugguuccuggaccugccccugcccuggcugcccggcgccgacaagcaggagagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucgugaucagagugcaguacgagggcgacggcagccccugcaagauccccuucgagaucauggaccuggagaagagauacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcaucgugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccaggaggagggcaucugcggcaucagaagcgugaccagacuggagaaccugauguggaagcagaucacccccgagcugaaccacauccuggccgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagcuacaaccagaccuuccugaucgacggccccgagaccaccgagugccccaacaccaacagagccuggaacagccuggagguggaggacuacggcuucggcguguucaccaccaacaucuggcugaagcugaaggagaagcaggacgccuucugcgacagcaagcugaugagcgccgccaucaaggacaacagagccgugcacgccgacaugggcuacuggaucgagagcgcccugaacgacaccuggaagaucgagaaggccagcuucaucgaggugaagaacugccacuggcccaagagccacacccuguggagcaacggcgugcuggagagcgagaugaucauccccaagaaccuggccggccccgugagccagcacaacuacagacccggcuaccacacccagaucgccggccccuggcaccugggcaagcuggagauggacuucgacuucugcgacggcaccaccgugaucgugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagguggacaacuucagccugggcgugcugggcauggcccuguuccuggaggagaugcugagaaccagagugggcaccaagcacgccauccugcugguggccgugagcuucgugacccugaucaccggcaacaugagcuucaaggaccugggcagagugguggugauggugggcgccaccauggccgacgacaucggcaugggcgugaccuaccuggcccugcuggccgccuucaaggugagacccaccuucgccgccggccugcugcugagaaagcugaccagcaaggagcugaugaugaccaccaucggcaucgugcugcugagccagagcaccauccccgagaccgugcuggagcugaccgacgcccuggcccugggcaugauggugcugaagaucgugagaaacauggagaaguaccagcuggccgugaccaucauggccauccugugcgugcccaacgccgugauccugcagaacgccuggaaggugagcugcaccauccuggccguggugagcgugagcccccugcugcugaccagcagccagcagaagaccgacuggaucccccuggcccugaccaucaagggccugaaccccaccgccaucuuccugaccacccugagcagaaccaacaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccaccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggccuguuccccaucagcauccccaucaccgccgccgccugguaccugugggaggugaagaagcagagagccggcgugcugugggacgugcccagccccccccccaugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacaagggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucaucgacaagaagggcaagguggugggccuguacggcaacggcguggugaccagaagcggcgccuacgugagcgccaucgcccagaccgagaagagcaucgaggacaaccccgagaucgaggacgacaucuucagaaagagaagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucaucgacgaggagagagagauccccgagagaagcuggaacaccggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaagauggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaagaccagagacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcagaggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucgccacccagcagcccgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggaccccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaucccccccgagaagugcgacacccugcugugcgacaucggcgagagcagccccaaccccaccguggaggccggcagaacccugagagugcugaaccugguggagaacuggcugaacaacaacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccagcggcaacaucgugagcagcgugaacaugaucagcagaaugcugaucaacagauucaccaugagacacaagaaggccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacgugcugcccaccgugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcagauucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacauggagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcguguucaagaacauccagcaccugaccgugaccgaggagguggccgugcagaacuggcuggccagagugggcagagagagacugagcagaauggccaucagcggcgacgacugcguggugaagccccuggacgacagauucgccaacgcccugaccgcccugaacgacaugggcaagaucagaaaggacauccagcagugggagcccagcaagggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugagagagaccgccugccugggcaagagcuacgcccagauguggagccugauguacuuccacagaagagaccugagacuggccgccaacgccaucugcagcgccgugcccagccacugggugcccaccagcagaaccaccuggagcauccacgccaagcacgaguggaugaccaccgaggacaugcugaccguguggaacagaguguggaucagagagaaccccuggauggaggacaagacccccguggagagcugggaggagauccccuaccugggcaagagagaggaccaguggugcggcagccugaucggccugaccagcagagccaccugggccaagaacauccaggccgccaucaaccaggugagaagccugaucggcaacgaggaguacaccgacuacaugcccagcaugaagagauucagaagagaggaggaggaggccggcgugcugugguga

SEQ ID NO: 17402 - RNA, 9876 nt, Artificial Sequence
  derived and/or modified CDS sequence (opt4) from DENV-2__EU482448__SS-prME
agcgccggcaugaucaucaugcugauccccaccgugauggccuuccaccugaccaccagaaacggcgagccccacaugaucgugggcauccaggagaagggcaagagccugcuguucaagaccgaggacggcgugaacaugugcacccugauggccauggaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgcccagagaaucgagaccuggauccugagacaccccggcuucaccaucauggccgccauccuggccuacaccaucggcaccacccacuuccagagagugcugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaaggaggagcaggacaagagauucgugugcaagcacagcaugguggacagaggcuggggcaacggcugcggccuguucggcaagggcggcaucgugaccugcgccauguucaccugcaagaagaacauggagggcaagaucgugcagcccgagaaccuggaguacaccaucguggugaccccccacagcggcgaggagcacgccgugggcaacgacaccggcaagcacggcaaggagaucaaggugaccccccagagcagcaucaccgaggccgagcugaccggcuacggcaccgugaccauggagugcagccccagaaccggccuggacuucaacgagauggugcugcugcagauggagaacaaggccuggcuggugcacagacagugguuccuggaccugccccugcccuggcugcccggcgccgacaagcaggagagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucgugaucagagugcaguacgagggcgacggcagccccugcaagauccccuucgagaucauggaccuggagaagagauacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcaucgugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccaggaggagggcaucugcggcaucagaagcgugaccagacuggagaaccugauguggaagcagaucacccccgagcugaaccacauccuggccgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagcuacaaccagaccuuccugaucgacggccccgagaccaccgagugccccaacaccaacagagccuggaacagccuggagguggaggacuacggcuucggcguguucaccaccaacaucuggcugaagcugaaggagaagcaggacgccuucugcgacagcaagcugaugagcgccgccaucaaggacaacagagccgugcacgccgacaugggcuacuggaucgagagcgcccugaacgacaccuggaagaucgagaaggccagcuucaucgaggugaagaacugccacuggcccaagagccacacccuguggagcaacggcgugcuggagagcgagaugaucauccccaagaaccuggccggccccgugagccagcacaacuacagacccggcuaccacacccagaucgccggccccuggcaccugggcaagcuggagauggacuucgacuucugcgacggcaccaccgugaucgugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagguggacaacuucagccugggcgugcugggcauggcccuguuccuggaggagaugcugagaaccagagugggcaccaagcacgccauccugcugguggccgugagcuucgugacccugaucaccggcaacaugagcuucaaggaccugggcagagugguggugauggugggcgccaccauggccgacgacaucggcaugggcgugaccuaccuggcccugcuggccgccuucaaggugagacccaccuucgccgccggccugcugcugagaaagcugaccagcaaggagcugaugaugaccaccaucggcaucgugcugcugagccagagcaccauccccgagaccgugcuggagcugaccgacgcccuggcccugggcaugauggugcugaagaucgugagaaacauggagaaguaccagcuggccgugaccaucauggccauccugugcgugcccaacgccgugauccugcagaacgccuggaaggugagcugcaccauccuggccguggugagcgugagcccccugcugcugaccagcagccagcagaagaccgacuggaucccccuggcccugaccaucaagggccugaaccccaccgccaucuuccugaccacccugagcagaaccaacaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccaccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggccuguuccccaucagcauccccaucaccgccgccgccugguaccugugggaggugaagaagcagagagccggcgugcugugggacgugcccagccccccccccaugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacaagggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucaucgacaagaagggcaagguggugggccuguacggcaacggcguggugaccagaagcggcgccuacgugagcgccaucgcccagaccgagaagagcaucgaggacaaccccgagaucgaggacgacaucuucagaaagagaagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucaucgacgaggagagagagauccccgagagaagcuggaacaccggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaagauggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaagaccagagacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcagaggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucgccacccagcagcccgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggaccccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaucccccccgagaagugcgacacccugcugugcgacaucggcgagagcagccccaaccccaccguggaggccggcagaacccugagagugcugaaccugguggagaacuggcugaacaacaacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccagcggcaacaucgugagcagcgugaacaugaucagcagaaugcugaucaacagauucaccaugagacacaagaaggccaccuacgagcccgacguggaccugggcagcggcaccagaaacaucggcaucgagagcgagauccccaaccuggacaucaucggcaagagaaucgagaagaucaagcaggagcacgagaucagcuggcacuacgaccaggaccaccccuacaagaccugggccuaccacggcagcuacgagaccaagcagaccggcagcgccagcagcauggugaacggcguggugagacugcugaccaagcccugggacgugcugcccaccgugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcagauucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacauggagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcguguucaagaacauccagcaccugaccgugaccgaggagguggccgugcagaacuggcuggccagagugggcagagagagacugagcagaauggccaucagcggcgacgacugcguggugaagccccuggacgacagauucgccaacgcccugaccgcccugaacgacaugggcaagaucagaaaggacauccagcagugggagcccagcaagggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugagagagaccgccugccugggcaagagcuacgcccagauguggagccugauguacuuccacagaagagaccugagacuggccgccaacgccaucugcagcgccgugcccagccacugggugcccaccagcagaaccaccuggagcauccacgccaagcacgaguggaugaccaccgaggacaugcugaccguguggaacagaguguggaucagagagaaccccuggauggaggacaagacccccguggagagcugggaggagauccccuaccugggcaagagagaggaccaguggugcggcagccugaucggccugaccagcagagccaccugggccaagaacauccaggccgccaucaaccaggugagaagccugaucggcaacgaggaguacaccgacuacaugcccagcaugaagagauucagaagagaggaggaggaggccggcgugcugugguga

SEQ ID NO: 17403 - RNA, 9876 nt, Artificial Sequence
  derived and/or modified CDS sequence (opt4) from DENV-2__EU482449__SS-prME
accgccggcgugaucaucaugcugauccccaccgccauggccuuccaccugaccaccagaaacggcgagccccacaugaucgugggcagacaggagaagggcaagagccugcuguucaagaccgaggacggcgugaacaugugcacccugauggccaucgaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgcccagagaaucgagaccuggauccugagacaccccggcuucaccaucauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaacgaggagcaggacaagagauucgugugcaagcacagcaugguggacagaggcuggggcaacggcugcggccuguucggcaagggcggcaucgugaccugcgccauguucaccugcaagaagaacauggagggcaagaucgugcagcccgagaaccuggaguacaccaucgugaucaccccccacagcggcgaggagcacgccgugggcaacgacaccggcaagcacggcaaggagaucaagaucaccccccagagcagcaacaccgaggccgagcugaccggcuacggcaccgugaccauggagugcagccccagaaccggccuggacuucaacgagauggugcugcugcagauggaggacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagaucgugaaggagaucgccgagacccagcacggcaccaucgugaucagagugcaguacgagggcgacggcagccccugcaagauccccuucgagaucauggaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgccaucaucaccuggaucggcaugaacagcagaagcaccagccugagcgugagccuggugcuggugggcgugaucacccuguaccugggcgccauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucaccaccaacaucuggcugaagcugagagagaagcaggacguguucugcgacagcaagcugaugagcgccgccaucaaggacaacagagccgugcacgccgacaugggcuacuggaucgagagcgcccugaacgacaccuggaagauggagaaggccagcuucaucgaggugaagagcugccacuggcccaagagccacacccuguggagcaacggcgugcuggagagcgagaugaucauccccaagagcuucgccggccccgugagccagcacaacuacagacccggcuacuacacccagaccgccggccccuggcaccugggcaagcuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugguggccgugagcuucaugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugauggccaccaucggcaucgcccugcugagccagagcaccauccccgagaccauccuggagcugaccgacgcccuggcccugggcaugauggugcugaagaucgugagaaacauggagaaguaccagcuggccgugaccaucauggccaucagcugcgugcccaacgccgugauccugcagaacgccuggaaggugagcugcaccauccuggccgccgugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccaccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggccuguuccccgugagcauccccaucaccgccgccgccugguaccugugggaggugaagaagcagagagccggcgugcugugggacgugcccagccccccccccgugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacagaggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucguggacagaaagggcaagguggugggccuguacggcaacggcguggugaccagaagcggcgccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucaucgacgaggagagagagauccccgagagaagcuggagcagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacagaguggccgccgagggcaucaacuacgccgacagaagauggugcuucgacggcgugaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagagacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcgugggcaagaugacccugggcauguucugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucgccacccaggagcccgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugaucgcccacuacgccaucaucggccccggccugcaggccaaggccaccagagaggcccagaagagagccgccgccggcaucaugaagaaccccaccguggacggcaucaccgugaucgaccuggaccccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccaucgaggccggcagaacccugagagugcugagccugguggagaacuggcugaacaacgacacccaguucugcaucaaggugcugaaccccuacaugcccagcgugaucgagaagauggagacccugcagagaaaguacggcggcgcccuggugagaaacccccugagcagaaacagcacccacgagauguacugggugagcaacgccaccggcaacaucgugagcagcgugaacaugaucagcagaaugcugaucaacagauucaccaugaagcacaagaaggccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacguggugcccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcagauucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacauggagggcgagcacaagagacuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcaucuucaagagcauccagcaccugaccgugaccgaggagaucgccgugcagaacuggcuggccagagugggcagagagagacugagcagaauggccaucagcggcgacgacugcguggugaagccccuggacgacagauucgccagcgcccugaccgcccugaacgacaugggcaaggugagaaaggacauccagcagugggagcccagcaagggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugaaggagaccgccugccugggcaagagcuacgcccagauguggagccugauguacuuccacagaagagaccugagacuggccgccaacgccaucugcagcgccgugcccagccacugggugcccaccagcagaaccaccuggagcauccacgccaagcacgaguggaugaccaccgaggacaugcugaccguguggaacagaguguggauccaggagaaccccuggauggaggacaagacccccguggagagcugggaggaggugcccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 17404 - RNA, 9876 nt, Artificial Sequence
  derived and/or modified CDS sequence (opt4) from DENV-2__EU482450__SS-prME
agcgccggcaugaucaucaugcugauccccaccgugauggccuuccaccugaccaccagaaacggcgagccccacaugaucgugggcauccaggagaagggcaagagccugcuguucaagaccgaggacggcgugaacaugugcacccugauggccauggaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgcccagagaaucgagaccuggauccugagacaccccggcuucaccaucauggccgccauccuggccuacaccaucggcaccacccacuuccagagagugcugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaaggaggagcaggacaagagauucgugugcaagcacagcaugguggacagaggcuggggcaacggcugcggccuguucggcaagggcggcaucgugaccugcgccauguucaccugcaagaagaacauggagggcaagaucgugcagcccgagaaccuggaguacaccaucguggugaccccccacagcggcgaggagcacgccgugggcaacgacaccggcaagcacggccaggagaucaaggugaccccccagagcagcaucaccgaggccgagcugaccggcuacggcaccgugaccauggagugcagccccagaaccggccuggacuucaacgagauggugcugcugcagauggagaacaaggccuggcuggugcacagacagugguuccuggaccugccccugcccuggcugcccggcgccgacaagcaggagagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucgugaucagagugcaguacgagggcgacggcagccccugcaagauccccuucgagaucauggaccuggagaagagauacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcaucgugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccaggaggagggcaucugcggcaucagaagcgugaccagacuggagaaccugauguggaagcagaucacccccgagcugaaccacauccuggccgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagcuacaaccagaccuuccugaucgacggccccgagaccgccgagugccccaacaccaacagagccuggaacagccuggagguggaggacuacggcuucggcguguucaccaccaacaucuggcugaagcugaaggagaagcaggacgccuucugcgacagcaagcugaugagcgccgccaucaaggacaacagagccgugcacgccgacaugggcuacuggaucgagagcgcccugaacgacaccuggaagaucgagaaggccagcuucaucgaggugaagaacugccacuggcccaagagccacacccuguggagcaacggcgugcuggagagcgagaugaucauccccaagaaccuggccggccccgugagccagcacaacuacagacccggcuaccacacccagaucgccggccccuggcaccugggcaagcuggagauggacuucgacuucugcgacggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagguggacaacuucagccugggcgugcugggcauggcccuguuccuggaggagaugcugagaaccagagugggcaccaagcacgccauccugcugguggccgugagcuucgugacccugaucaccggcaacaugagcuucaaggaccugggcagagugguggugauggugggcgccaccaugaccgacgacaucggcaugggcgugaccuaccuggcccugcuggccgccuucaaggugagacccaccuucgccgccggccugcugcugagaaagcugaccagcaaggagcugaugaugaccaccaucggcaucgugcugcugagccagagcgccauccccgagaccgugcuggagcugaccgacgcccuggcccugggcaugauggugcugaagaucgugagaaacauggagaaguaccagcuggccgugaccaucauggccauccugugcgugcccaacgccgugauccugcagaacgccuggaaggugagcugcaccauccuggccguggugagcgugagcccccugcugcugaccagcagccagcagaagaccgacuggaucccccuggcccugaccaucaagggccugaaccccaccgccaucuuccugaccacccugagcagaaccaacaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccaccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggccuguuccccaucagcauccccaucaccgccgccgccugguaccugugggaggugaagaagcagagagccggcgugcugugggacgugcccagccccccccccaugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacaagggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucaucgacaagaagggcaagguggugggccuguacggcaacggcguggugaccagaagcggcgccuacgugagcgccaucgcccagaccgagaagagcaucgaggacaaccccgagaucgaggacgacaucuucagaaagagaagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucaucgacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaagauggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaagaccagagacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcagaggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucgccacccagcagcccgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggaccccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaugggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaucccccccgagaagugcgacacccugcugugcgacaucggcgagagcagccccaaccccaccguggaggccggcagaacccugagagugcugaaccugguggagaacuggcugaacaacaacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccagcggcaacaucgugagcagcgugaacaugaucagcagaaugcugaucaacagauucaccaugagacacaagaaggccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacgugcugcccaccgugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcagauucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacauggagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcguguucaagaacauccagcaccugaccgugaccgaggagguggccgugaagaacuggcuggccagagugggcagagagagacugagcagaauggccaucagcggcgacgacugcguggugaagccccuggacgacagauucgccaacgcccugaccgcccugaacgacaugggcaagaucagaaaggacauccagcagugggagcccagcaagggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugagagagaccgccugccugggcaagagcuacgcccagauguggagccugauguacuuccacagaagagaccugagacuggccgccaacgccaucugcagcgccgugcccagccacugggugcccaccagcagaaccaccuggagcauccacgccaagcacgaguggaugaccaccgaggacaugcugaccguguggaacagaguguggaucagagagaaccccuggauggaggacaagacccccguggagagcugggaggagauccccuaccugggcaagagagaggaccaguggugcggcagccugaucggccugaccagcagagccaccugggccaagaacauccaggccgccaucaaccaggugagaagccugaucggcaacgaggaguacgccgacuacaugcccagcaugaagagauucagaagagaggaggaggaggccggcgugcugugguga

SEQ ID NO: 17405 - RNA, 9876 nt, Artificial Sequence
  derived and/or modified CDS sequence (opt4) from DENV-2__EU569721__SS-prME
agcgccggcaugaucaucaugcugauccccaccgugauggccuuccaccugaccaccagaaacggcgagccccacaugaucgugggcauccaggagaagggcaagagccugcuguucaagaccgaggacggcgugaacaugugcacccugauggccauggaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgcccagagaaucgagaccuggauccugagacaccccggcuucaccaucauggccgccauccuggccuacaccaucggcaccacccacuuccagagagugcugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaaggaggagcaggacaagagauucgugugcaagcacagcaugguggacagaggcuggggcaacggcugcggccuguucggcaagggcggcaucgugaccugcgccauguucaccugcaagaagaacauggagggcaagaucgugcagcccgagaaccuggaguacaccaucguggugaccccccacagcggcgaggagcacgccgugggcaacgacaccggcaagcacggccaggagaucaaggugaccccccagagcagcaucaccgaggccgagcugaccggcuacggcaccgugaccauggagugcagccccagaaccggccuggacuucaacgagauggugcugcugcagauggagaacaaggccuggcuggugcacagacagugguuccuggaccugccccugcccuggcugcccggcgccgacaagcaggagagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucgugaucagagugcaguacgagggcgacggcagccccugcaagauccccuucgagaucauggaccuggagaagagauacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcaucgugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccaggaggagggcaucugcggcaucagaagcgugaccagacuggagaaccugauguggaagcagaucacccccgagcugaaccacauccuggccgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagcuacaaccagaccuuccugaucgacggccccgagaccgccgagugccccaacaccaacagagccuggaacagccuggagguggaggacuacggcuucggcguguucaccaccaacaucuggcugaagcugaaggagaagcaggacgccuucugcgacagcaagcugaugagcgccgccaucaaggacaacagagccgugcacgccgacaugggcuacuggaucgagagcgcccugaacgacaccuggaagaucgagaaggccagcuucaucgaggugaagaacugccacuggcccaagagccacacccuguggagcaacggcgugcuggagagcgagaugaucauccccaagaaccuggccggccccgugagccagcacaacuacagacccggcuaccacacccagaucgccggccccuggcaccugggcaagcuggagauggacuucgacuucugcgacggcaccaccgugaucgugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagguggacaacuucagccugggcgugcugggcauggcccuguuccuggaggagaugcugagaaccagagugggcaccaagcacgccauccugcugguggccgugagcuucgugacccugaucaccggcaacaugagcuucaaggaccugggcagagugguggugauggugggcgccaccauggccgacgacaucggcaugggcgugaccuaccuggcccugcuggccgccuucaaggugagacccaccuucgccgccggccugcugcugagaaagcugaccagcaaggagcugaugaugaccaccaucggcaucgugcugcugagccagagcaccauccccgagaccgugcuggagcugaccgacgcccuggcccugggcaugauggugcugaagaucgugagaaacauggagaaguaccagcuggccgugaccaucauggccauccugugcgugcccaacgccgugauccugcagaacgccuggaaggugagcugcaccauccuggccguggugagcgugagcccccugcugcugaccagcagccagcagaagaccgacuggaucccccuggcccugaccaucaagggccugaaccccaccgccaucuuccugaccacccugagcagaaccaacaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccaccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggccuguuccccaucagcauccccaucaccgccgccgccugguaccugugggaggugaagaagcagagagccggcgugcugugggacgugcccagcccccugcccaugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacaagggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucaucgacaagaagggcaagguggugggccuguacggcaacggcguggugaccagaagcggcgccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucaucgacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaagauggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaagaccagagacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcagaggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucgccacccagcagcccgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggaccccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaugggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaucccccccgagaagugcgacacccugcugugcgacaucggcgagagcagccccaaccccaccguggaggccggcagaacccugagagugcugaaccugguggagaacuggcugaacaacaacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccagcggcaacaucgugagcagcgugaacaugaucagcagaaugcugaucaacagauucaccaugagacacaagaaggccaccuacgagcccgacguggaccugggcagcggcaccagaaacaucggcaucgagagcgagacccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacgugcugcccaccgugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcagauucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacauggagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcguguucaagaacauccagcaccugaccgugaccgaggagguggccgugcagaacuggcuggccagagugggcagagagagacugagcagaauggccaucagcggcgacgacugcguggugaagccccuggacgacagauucgccaacgcccugaccgcccugaacgacaugggcaagaucagaaaggacauccagcagugggagcccagcaagggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugagagagaccgccugccugggcaagagcuacgcccagauguggagccugauguacuuccacagaagagaccugagacuggccgccaacgccaucugcagcgccgugcccagccacugggugcccaccagcagaaccaccuggagcauccacgccaagcacgaguggaugaccaccgaggacaugcugaccguguggaacagaguguggaucagagagaaccccuggauggaggacaagacccccguggagagcugggaggagauccccuaccugggcaagagagaggaccaguggugcggcagccugaucggccugaccagcagagccaccugggccaagaacauccaggccgccaucaaccaggugagaagccugaucggcaacgaggaguacaccgacuacaugcccagcaugaagagauucagaagagaggaggaggaggccggcgugcugugguga

SEQ ID NO: 17406 - RNA, 9876 nt, Artificial Sequence
  derived and/or modified CDS sequence (opt4) from DENV-2__EU482451__SS-prME
agcgccggcaugaucaucaugcugauccccaccgugauggccuuccaccugaccaccagaaacggcgagccccacaugaucgugggcauccaggagaagggcaagagccugcuguucaagaccgaggacggcgugaacaugugcacccugauggccauggaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgcccagagaaucgagaccuggauccugagacaccccggcuucaccaucauggccgccauccuggccuacaccaucggcaccacccacuuccagagagugcugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaaggaggagcaggacaagagauucgugugcaagcacagcaugguggacagaggcuggggcaacggcugcggccuguucggcaagggcggcaucgugaccugcgccauguucaccugcaagaagaacauggagggcaagaucgugcagcccgagaaccuggaguacaccaucguggugaccccccacagcggcgaggagcacgccgugggcaacgacaccggcaagcacggcaaggagaucaaggugaccccccagagcagcaucaccggcgccgagcugaccggcuacggcaccgugaccauggagugcagccccagaaccggccuggacuucaacgagauggugcugcugcagauggagaacaaggccuggcuggugcacagacagugguuccuggaccugccccugcccuggcugcccggcgccgacaagcaggagagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucgugaucagagugcaguacgagggcgacggcagccccugcaagauccccuucgagaucauggaccuggagaagagauacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcaucgugacccuguaccugggcgugauggugcaggccgacagcggcugcguggugagcuggaagaacaaggagcugaagugcggcagcggcaucuucgugaccgacaacgugcacaccuggaccgagcaguacaaguuccagcccgagagccccagcaagcuggccagcgccauccagaaggcccaggaggagggcaucugcggcaucagaagcgugaccagacuggagaaccugauguggaagcagaucacccccgagcugaaccacauccuggccgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagcuacaaccagaccuuccugaucgacggccccgagaccgccgagugccccaacaccaacagagccuggaacagccuggagguggaggacuacggcuucggcguguucaccaccaacaucuggcugaagcugaaggagaagcaggacgccuucugcgacagcaagcugaugagcgccgccaucaaggacaacagagccgugcacgccgacaugggcuacuggaucgagagcgcccugaacgacaccuggaagaucgagaaggccagcuucaucgaggugaagaacugccacuggcccaagagccacacccuguggagcaacggcgugcuggagagcgagaugaucauccccaagaaccuggccggccccgugagccagcacaacuacagacccggcuaccacacccagaucgccggccccuggcaccugggcaagcuggagauggacuucgacuucugcgacggcaccaccgugaucgugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagguggacaacuucagccugggcgugcugggcauggcccuguuccuggaggagaugcugagaaccagagugggcaccaagcacgccauccugcugguggccgugagcuucgugacccugaucaccggcaacaugagcuucaaggaccugggcagagugguggugauggugggcgccaccauggccgacgacaucggcaugggcgugaccuaccuggcccugcuggccgccuucaaggugagacccaccuucgccgccggccugcugcugagaaagcugaccagcaaggagcugaugaugaccaccaucggcaucgugcugcugagccagagcaccauccccgagaccgugcuggagcugaccgacgcccuggcccugggcaugauggugcugaagaucgugagaaacauggagaaguaccagcuggccgugaccaucauggccauccugugcgugcccaacgccgugauccugcagaacgccuggaaggugagcugcaccauccuggccguggugagcgugagcccccugcugcugaccagcagccagcagaagaccgacuggaucccccuggcccugaccaucaagggccugaaccccaccgccaucuuccugaccacccugagcagaaccaacaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccaccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggccuguuccccaucagcauccccaucaccgccgccgccugguaccugugggaggugaagaagcagagagccggcgugcugugggacgugcccagccccccccccaugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacaagggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccagcaccggcaccaucggcgccgugagccuggacuucagccccggcaccagcggcagccccaucaucgacaagaagggcaagguggugggccuguacggcaacggcguggugaccagaagcggcgccuacgugagcgccaucgcccagaccgagaagagcaucgaggacaaccccgagaucgaggacgacaucuucagaaagagaagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucaucgacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccaagaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaagauggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaagaccagagacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcagaggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucgccacccagcagcccgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggaccccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaccuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaucccccccgagaagugcgacacccugcugugcgacaucggcgagagcagccccaaccccaccguggaggccggcagaacccugagagugcugaaccugguggagaacuggcugaacaacaacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccagcggcaacaucgugagcagcgugaacaugaucagcagaaugcugaucaacagauucaccaugagacacaagaaggccaccuacgagcccgacguggaccugggcagcggcaccagaaacaucggcaacgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacgugcugcccaccgugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcagauucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacauggagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcguguucaagaacauccagcaccugaccgugaccgaggagguggccgugcagaacuggcuggccagagugggcagagagagacugagcagaauggccaucagcggcgacgacugcguggugaagccccuggacgacagauucgccaacgcccugaccgcccugaacgacaugggcaagaucagaaaggacauccagcagugggagcccagcaagggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugagagagaccgccugccugggcaagagcuacgcccagauguggagccugauguacuuccacagaagagaccugagacuggccgccaacgccaucugcagcgccgugcccagccacugggugcccaccagcagaaccaccuggagcauccacgccaagcacgaguggaugaccaccgaggacaugcugaccguguggaacagaguguggaucagagagaaccccuggauggaggacaagacccccguggagagcugggaggagauccccuaccugggcaagagagaggaccaguggugcggcagccugaucggccugaccagcagagccaccugggccaagaacauccagguggccaucaaccaggugagaagccugaucggcaacgaggaguacaccgacuacaugcccagcaugaagagauucagaagagaggaggaggaggccggcgugcugugguga

SEQ ID NO: 17407 - RNA, 9876 nt, Artificial Sequence
  derived and/or modified CDS sequence (opt4) from DENV-2__EU660413__SS-prME
agcgccggcaugaucaucaugcugauccccaccgugauggccuuccaccugaccaccagaaacggcgagccccacaugaucgugggcauccaggagaagggcaagagccugcuguucaagaccgaggacggcgugaacaugugcacccugauggccauggaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgcccagagaaucgagaccuggauccugagacaccccggcuucaccaucauggccgccauccuggccuacaccaucggcaccacccacuuccagagagugcugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaaggaggagcaggacaagagauucgugugcaagcacagcaugguggacagaggcuggggcaacggcugcggccuguucggcaagggcggcaucgugaccugcgccauguucaccugcaagaagaacauggagggcaagaucgugcagcccgagaaccuggaguacaccaucguggugaccccccacagcggcgaggagcacgccgugggcaacgacaccggcaagcacggcaaggagaucaaggugaccccccagagcagcaucaccgaggccgagcugaccggcuacggcaccgugaccauggagugcagccccagaaccggcuucgacuucaacgagauggugcugcugcagauggagaacaaggccuggcuggugcacagacagugguuccuggaccugccccugcccuggcugcccggcgccgacaagcaggagagcaacuggauccagaaggagacccuggugaccuucaagaacccccacgccaagaagcaggacguggugauccugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucgugaucagagugcaguacgagggcgacggcagccccugcaagauccccuucgagaucauggaccuggagaagagauacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcaucgugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccaggaggagggcaucugcggcaucagaagcgugaccagacuggagaaccugauguggaagcagaucacccccgagcugaaccacauccuggccgagaacgaggugaagcugaccaucaugaccggcgacaucagaggcaucaugcaggccggcaagagaagccugagaccccagcccaccgagcugaaguacagcuggaagaccuggggcaaggccaagaugcugagcaccgagagcuacaaccagaccuuccugaucgacggccccgagaccgccgagugccccaacaccaacagagccuggaacagccuggagguggaggacuacggcuucggcguguucaccaccaacaucuggcugaagcugaaggagaagcaggacgccuucugcgacagcaagcugaugagcgccgccaucaaggacaacagagccgugcacgccgacaugggcuacuggaucgagagcgcccugaacgacaccuggaagaucgagaaggccagcuucaucgaggugaagaacugccacuggcccaagagccacacccuguggagcaacggcgugcuggagagcgagaugaucauccccaagaaccuggccggccccgugagccagcacaacuacagacccggcuaccacacccagaucgccggccccuggcaccugggcaagcuggagauggacuucgacuucugcgacggcaccaccgugaucgugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagguggacaacuucagccugggcgugcugggcauggcccuguuccuggaggagaugcugagaaccagagugggcaccaagcacgccauccugcugguggccgugagcuucgugacccugaucaccggcaacaugagcuucaaggaccugggcagagugguggugauggugggcgccaccauggccgacgacaucggcaugggcgugaccuaccuggcccugcuggccgccuucaaggugagacccaccuucgccgccggccugcugcugagaaagcugaccagcaaggagcugaugaugaccaccaucggcaucgugcugcugagccagagcaccauccccgagaccgugcuggagcugaccgacgcccuggcccugggcaugauggugcugaagaucgugagaaacauggagaaguaccagcuggccgugaccaucauggccauccugugcgugcccaacgccgugauccugcagaacgccuggaaggugagcugcaccauccuggccguggugagcgugagcccccugcugcugaccagcagccagcagaagaccgacuggaucccccuggcccugaccaucaagggccugagccccaccgccaucuuccugaccacccugagcagaagcaacaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccaccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggccuguuccccaucagcauccccaucaccgccgccgccugguaccugugggaggugaagaagcagagagccggcgugcugugggacgugcccagccccccccccaugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacaagggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucaucgacaagaagggcaagguggugggccuguacggcaacggcguggugaccagaagcggcgccuacgugagcgccaucgcccagaccgagaagagcaucgaggacaaccccgagaucgaggacgacaucuucagaaagagaagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucaucgacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaagauggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaagaccagagacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcagaggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcggcaucgccacccagcagcccgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggaccccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaucccccccgagaagugcgacacccugcugugcgacaucggcgagagcagccccaaccccaccguggaggccggcagaacccugagagugcugaaccugguggagaacuggcugaacaacaacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccagcggcaacaucgugagcagcgugaacaugaucagcagaaugcugaucaacagauucaccaugagacacaagaaggccaccuacgagcccgacguggaccugggcagcggcaccagaaacaucggcaucgagagcgagaagcccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacgugcugcccaccgugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcagauucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacauggagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcguguucaagaacauccagcaccugaccgugaccgaggagguggccgugcacaacuggcuggccagagugggcagagagagacugagcagaauggccaucagcggcgacgacugcguggugaagccccuggacgacagauucgccaacgcccugaccgcccugaacgacaugggcaagaucagaaaggacauccagcagugggagcccagcaagggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugagagagaccgccugccugggcaagagcuacgcccagauguggagccugauguacuuccacagaagagaccugagacuggccgccaacgccaucugcagcgccgugcccagccacugggugcccaccagcagaaccaccuggagcauccacgccaagcacgaguggaugaccaccgaggacaugcugaccguguggaacagaguguggaucagagagaaccccuggauggaggacaagacccccguggagagcugggaggagauccccuaccugggcaagagagaggaccaguggugcggcagccugaucggccugaccagcagagccaccugggccaagaacauccaggccgccaucaaccaggugagaagccugaucggcaacgaggaguacaccgacuacaugcccagcaugaagagauucagaagagaggaggaggaggccggcgugcugugguga

SEQ ID NO: 17408 - RNA, 9876 nt, Artificial Sequence
  derived and/or modified CDS sequence (opt4) from DENV-2__EU660414__SS-prME
agcgccggcaugaucaucaugcugauccccaccgugauggccuuccaccugaccaccagaaacggcgagccccacaugaucgugggcauccaggagaagggcaagagccugcuguucaagaccgaggacggcgugaacaugugcacccugauggccauggaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgcccagagaaucgagaccugggugcugagacaccccggcuucaccaucauggccgccauccuggccuacaccaucggcaccacccacuuccagagagugcugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaaggaggagcaggacaagagauucgugugcaagcacagcaugguggacagaggcuggggcaacggcugcggccuguucggcaagggcggcaucgugaccugcgccauguucaccugcaagaagaacauggagggcaagaucgugcagcccgagaaccuggaguacaccaucguggugaccccccacagcggcgaggagcacgccgugggcaacgacaccggcaagcacggccaggagaucaaggugaccccccagagcagcaucaccgaggccgagcugaccggcuacggcaccgugaccauggagugcagccccagaaccggccuggacuucaacgagauggugcugcugcagauggagaacaaggccuggcuggugcacagacagugguuccuggaccugccccugcccuggcugcccggcgccgacaagcaggagagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucgugaucagagugcaguacgagggcgacggcagccccugcaagauccccuucgagaucauggaccuggagaagagauacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcaucgugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccaggaggagggcaucugcggcaucagaagcgugaccagacuggagaaccugauguggaagcagaucacccccgagcugaaccacauccuggccgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagcuacaaccagaccuuccugaucgacggccccgagaccgccgagugccccaacaccaacagagccuggaacagccuggagguggaggacuacggcuucggcguguucaccaccaacaucuggcugaagcugaaggagaagcaggacgccuucugcgacagcaagcugaugagcgccgccaucaaggacaacagagccgugcacgccgacaugggcuacuggaucgagagcgcccugaacgacaccuggaagaucgagaaggccagcuucaucgaggugaagaacugccacuggcccaagagccacacccuguggagcaacggcgugcuggagagcgagaugaucauccccaagaaccuggccggccccgugagccagcacaacuacagacccggcuaccacacccagaucgccggccccuggcaccugggcaagcuggagauggacuucgacuucugcgacggcaccaccgugaucgugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagguggacaacuucagccugggcgugcugggcauggcccuguuccuggaggagaugcugagaaccagagugggcaccaagcacgccauccugcugguggccgugagcuucgugacccugaucaccggcaacaugagcuucaaggaccugggcagagugguggugauggugggcgccaccauggccgacgacaucggcaugggcgugaccuaccuggcccugcuggccgccuucaaggugagacccaccuucgccgccggccugcugcugagaaagcugaccagcaaggagcugaugaugaccaccaucggcaucgugcugcugagccagagcaccauccccgagaccgugcuggagcugaccgacgcccuggcccugggcaugauggugcugaagaucgugagaaacauggagaaguaccagcuggccgugaccaucauggccauccugugcgugcccaacgccgugauccugcagaacgccuggaaggugagcugcaccauccuggccguggugagcgugagcccccugcugcugaccagcagccagcagaagaccgacuggaucccccuggcccugaccaucaagggccugaaccccaccgccaucuuccugaccacccugagcagaaccaacaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccaccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggccuguuccccaucagcauccccaucaccgccgccgccugguaccugugggaggugaagaagcagagagccggcgugcugugggacgugcccagccccccccccaugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacaagggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucaucgacaagaagggcaagguggugggccuguacggcaacggcguggugaccagaagcggcgccuacgugagcgccaucgcccagaccgagaagagcaucgaggacaaccccgagaucgaggacgacaucuucagaaagagaagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcaacagagaccccuucccccagagcaacgcccccaucaucgacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagaaucaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaagauggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaagaccagagacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcagaggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucgccacccagcagcccgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggaccccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcagccccggcagauucuggaacaccaccaucgccgugagcauggccaacaucuucagaggcagcuaccuggccggcgccggccugcuguucagcaucaugaagaacaccaccaacaccagaagaggcaccggcaacaugggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaucccccccgagaagugcgacacccugcugugcgacaucggcgagagcagccccaaccccaccguggaggccggcagaacccugagagugcugaaccugguggagaacuggcugaacaacaacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccagcggcaacaucgugagcagcgugaacaugaucagcagaaugcugaucaacagauucaccaugagacacaagaaggccaccuacgagcccgacguggaccugggcagcggcaccagaaacaucggcaucgagagcgagacccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacgugcugcccaccgugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcagauucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacauggagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcguguucaagaacauccagcaccugaccgugaccgaggagguggccgugcagaacuggcuggccagagugggcagagagagacugagcagaauggccaucagcggcgacgacugcguggugaagccccuggacgacagauucgccaacgcccugaccgcccugaacgacaugggcaagaucagaaaggacauccagcagugggagcccagcaagggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugagagagaccgccugccugggcaagagcuacgcccagauguggagccugauguacuuccacagaagagaccugagacuggccgccaacgccaucugcagcgccgugcccagccacugggugcccaccagcagaaccaccuggagcauccacgccaagcacgaguggaugaccaccgaggacaugcugaccguguggaacagaguguggaucagagagaaccccuggauggaggacaagacccccguggagagcugggaggagauccccuaccugggcaagagagaggaccaguggugcggcagccugaucggccugaccagcagagccaccugggccaagaacauccagguggccaucaaccaggugagaagccugaucggcaacgaggaguacaccgacuacaugcccagcaugaagagauucagaagagaggaggaggaggccggcgugcugugguga

SEQ ID NO: 17409 - RNA, 9876 nt, Artificial Sequence
  derived and/or modified CDS sequence (opt4) from DENV-2__EU660415__SS-prME
agcgccggcaugaucaucaugcugauccccaccgugauggccuuccaccugaccaccagaaacggcgagccccacaugaucgugggcauccaggagaagggcaagagccugcuguucaagaccgaggacggcgugaacaugugcacccugauggccauggaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgcccagagaaucgagaccuggauccugagacaccccggcuucaccaucauggccgccauccuggccuacaccaucggcaccacccacuuccagagagugcugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaaggaggagcaggacaagagauucgugugcaagcacagcaugguggacagaggcuggggcaacggcugcggccuguucggcaagggcggcaucgugaccugcgccauguucaccugcaagaagaacauggagggcaagaucgugcagcccgagaaccuggaguacaccaucguggugaccccccacagcggcgaggagcacgccgugggcaacgacaccggcaagcacggcaaggagaucaaggugaccccccagagcagcaucaccgaggccgagcugaccggcuacggcaccgugaccauggagugcagccccagaaccggccuggacuucaacgagauggugcugcugcagauggagaacaaggccuggcuggugcacagacagugguuccuggaccugccccugcccuggcugcccggcgccgacaagcaggagagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucgugaucagagugcaguacgagggcgacggcagccccugcaagauccccuucgagaucauggaccuggagaagagauacgugcugggcagacugaucaccgugaaccccaucgugaccgagaaggacagccccgugaacaucgaggccgagccccccuucggcgacagcuacaucaucaucggcgugggccccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcaucgugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccaggaggagggcaucugcggcaucagaagcgugaccagacuggagaaccugauguggaagcagaucacccccgagcugaaccacauccuggccgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagcuacaaccagaccuuccugaucgacggccccgagaccgccgagugccccaacaccaacagagccuggaacagccuggagguggaggacuacggcuucggcguguucaccaccaacaucuggcugaagcugaaggagaagcaggacgccuucugcgacagcaagcugaugagcgccgccaucaaggacaacagagccgugcacgccgacaugggcuacuggaucgagagcgcccugaacgacaccuggaagaucgagaaggccagcuucaucgaggugaagaacugccacuggcccaagagccacacccuguggagcaacggcgugcuggagagcgagaugaucauccccaagaaccuggccggccccgugagccagcacaacuacagacugggcuaccacacccagaucgccggccccuggcaccugggcaagcuggagauggacuucgacuucugcgacggcaccaccgugaucgugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagguggacaacuucagccugggcgugcugggcauggcccuguuccuggaggagaugcugagaaccagagugggcaccaagcacgccauccugcugguggccgugagcuucgugacccugaucaccggcaacaugagcuucaaggaccugggcagagugguggugauggugggcgccaccauggccgacgacaucggcaugggcgugaccuaccuggcccugcuggccgccuucaaggugagacccaccuucgccgccggccugcugcugagaaagcugaccagcaaggagcugaugaugaccaccaucggcaucgugcugcugagccagagcaccauccccgagaccgugcuggagcugaccgacgcccuggcccugggcaugauggugcugaagaucgugagaaacauggagaaguaccagcuggccgugaccaucauggccauccugugcgugcccaacgccgugauccugcagaacgccuggaaggugagcugcaccauccuggccguggugagcgugagcccccugcugcugaccagcagccagcagaagaccgacuggaucccccuggcccugaccaucaagggccugaaccccaccgccaucuuccugaccacccugagcagaaccaacaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccaccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggccuguuccccaucagcauccccaucaccgccgccgccugguaccugugggaggugaagaagcagagagccggcgugcugugggacgugcccagccccccccccaugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacaagggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucaucgacaagaagggcaagguggugggccuguacggcaacggcguggugaccagaagcggcgccuacgugagcgccaucgcccagaccgagaagggcaucgaggacaaccccgagaucgaggacgacaucuucagaaagagaagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucaucgacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaagauggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaagaccagagacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcagaggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggacuucggccugggcagcaucgccacccagcagcccgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggaccccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaucccccccgagaagugcgacacccugcugugcgacaucggcgagagcagccccaaccccaccguggaggccggcagaacccugagagugcugaaccugguggagaacuggcugaacaacaacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccagcggcaacaucgugagcagcgugaacaugaucagcagaaugcugaucaacagauucaccaugagacacaagaaggccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacgugcugcccaccgugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcagauucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacauggagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcguguucaagaacauccagcaccugaccgugaccgaggagguggccgugcagaacuggcuggccagagugggcagagagagacugagcagaauggccaucagcggcgacgacugcguggugaagccccuggacgacagauucgccaacgcccugaccgcccugaacgacaugggcaagaucagaaaggacauccagcagugggagcccagcaagggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugagagagaccgccugccugggcaagagcuacgcccagauguggagccugauguacuuccacagaagagaccugagacuggccgccaacgugaucugcagcgccgugcccagccacugggugcccaccagcagaaccaccuggagcauccacgccaagcacgaguggaugaccaccgaggacaugcugaccguguggaacagaguguggaucagagagaaccccuggauggaggacaagacccccguggagagcugggaggagauccccuaccugggcaagagagaggaccaguggugcggcagccugaucggccugaccagcagagccaccugggccaagaacauccaggccgccaucaaccaggugagaagccugaucggcaacgaggaguacaccgacuacaugcccagcaugaagagauucagaagagaggaggaggaggccggcgugcugugguga

SEQ ID NO: 17410 - RNA, 9876 nt, Artificial Sequence
  derived and/or modified CDS sequence (opt4) from DENV-2__EU687249__SS-prME
agcgccggcaugaucaucaugcugauccccaccgugauggccuuccaccugaccaccagaaacggcgagccccacaugaucgugggcauccaggagaagggcaagagccugcuguucaagaccgaggacggcgugaacaugugcacccugauggccauggaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgcccagagaaucgagaccuggauccugagacaccccggcuucaccaucauggccgccauccuggccuacaccaucggcaccacccacuuccagagagugcugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaaggaggagcaggacaagagauucgugugcaagcacagcaugguggacagaggcuggggcaacggcugcggccuguucggcaagggcggcaucgugaccugcgccauguucaccugcaagaagaacauggagggcaagaucgugcagcccgagaaccuggaguacaccaucguggugaccccccacagcggcgaggagcacgccgugggcaacgacaccggcaagcacggcaaggagaucaaggugaccccccagagcagcaucaccgaggccgagcugaccggcuacggcaccgugaccauggagugcagccccagaaccggccuggacuucaacgagauggugcugcugcagauggagaacaaggccuggcuggugcacagacagugguuccuggaccugccccugcccuggcugcccggcgccgacaagcaggagagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucgugaucagagugcaguacgagggcgacggcagccccugcaagauccccuucgagaucauggaccuggagaagagauacauccugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcaucgugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggccagagaggagggcaucugcggcaucagaagcgugaccagacuggagaaccugauguggaagcagaucacccccgagcugaaccacauccuggccgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagcuacaaccagaccuuccugaucgacggccccgagaccgccgagugccccaacaccaacagagccuggaacagccuggagguggaggacuacggcuucggcguguucaccaccaacaucuggcugaagcugaaggagaagcaggacgccuucugcgacagcaagcugaugagcgccgccaucaaggacaacagagccgugcacgccgacaugggcuacuggaucgagagcgcccugaacgacaccuggaagaucgagaaggccagcuucaucgaggugaagaacugccacuggcccaagagccacacccuguggagcaacggcgugcuggagagcgagaugaucauccccaagaaccuggccggccccgugagccagcacaacuacagacccggcuaccacacccagaucgccggccccuggcaccugggcaagcuggagauggacuucgacuucugcgacggcaccaccgugaucgugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagguggacaacuucagccugggcgugcugggcauggcccuguuccuggaggagaugcugagaaccagagugggcaccaagcacgccauccugcugguggccgugagcuucaugacccugaucaccggcaacaugagcuucaaggaccugggcagagugguggugauggugggcgccaccauggccgacgacaucggcaugggcgugaccuaccuggcccugcuggccgccuucaaggugagacccaccuucgccgccggccugcugcugagaaagcugaccagcaaggagcugaugaugaccaccaucggcaucgugcugcugagccagagcaccauccccgagaccgugcuggagcugaccgacgcccuggcccugggcaugauggugcugaagaucgugagaaacauggagaaguaccagcuggccgugaccaucauggccauccugugcgugcccaacgccgugauccugcagaacgccuggaaggugagcugcaccauccuggccguggugagcgugagcccccugcugcugaccagcagccagcagaagaccgacuggaucccccuggcccugaccaucaagggccugaaccccaccgccaucuuccugaccacccugagcagaaccaacaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccaccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggccuguuccccaucagcauccccaucaccgccgccgccugguaccugugggaggugaagaagcagagagccggcgugcugugggacgugcccagccccccccccaugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacaagggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucaucgacaagaagggcaagguggugggccuguacggcaacggcguggugaccagaagcggcgccuacgugagcgccaucgcccagaccgagaagagcaucgaggacaaccccgagaucgaggacgacaucuucagaaagagaagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucaucgacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaagauggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaagaccagagacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcagaggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucgccacccagcagcccgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggaccccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcagagugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaucccccccgagaagugcgacacccugcugugcgacaucggcgagagcagccccaaccccaccguggaggccggcagaacccugagagugcugaaccugguggagaacuggcugaacaacaacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccagcggcaacaucgugagcagcgugaacaugaucagcagaaugcugaucaacagauucaccaugagacacaagaaggccaccuacgagcccgacguggaccugggcagcggcaccagaaacaucggcaucgagagcgaggugcccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacgugcugcccaccgugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcagauucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacauggagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcguguucaagaacauccagcaccugaccgugaccgaggagguggccgugcagaacuggcuggccagagugggcagagagagacugagcagaauggccaucagcggcgacgacugcguggugaagccccuggacgacagauucgccaacgcccugaccgcccugaacgacaugggcaagaucagaaaggacauccagcagugggagcccagcaagggcuggagcgacuggacccaggugcccuucugcagccaccacuuccacgagcugaucaugaaggacggcagagugcugguggugcccugcagaaaccaggacgagcugaucggcagagccagaaucagccagggcgccggcuggagccugagagagaccgccugccugggcaagagcuacgcccagauguggagccugauguacuuccacagaagagaccugagacuggccgccaacgccaucugcagcgccgugcccagccacugggugcccaccagcagaaccaccuggagcauccacgccaagcacgaguggaugaccaccgaggacaugcugaccguguggaacagaguguggaucagagagaaccccuggauggaggacaagacccccguggagagcugggaggagauccccuaccugggcaagagagaggaccaguggugcggcagccugaucggccugaccagcagagccaccugggccaagaacauccaggccgccaucaaccaggugagaagccugaucggcaacgaggaguacaccgacuacaugcccagcaugaagagauucagaagagaggaggaggaggccggcgugcugugguga

SEQ ID NO: 17411 - RNA, 9876 nt, Artificial Sequence
  derived and/or modified CDS sequence (opt4) from DENV-2__EU660416__SS-prME
agcgccggcaugaucaucaugcugauccccaccgugauggccuuccaccugaccaccagaaacggcgagccccacaugaucgugggcauccaggagaagggcaagagccugcuguucaagaccgaggacggcgugaacaugugcacccugauggccauggaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgcccagagaaucgagaccuggauccugagacaccccggcuucaccaucauggccgccauccuggccuacaccaucggcaccacccacuuccagagagugcugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaaggaggagcaggacaagagauucgugugcaagcacagcaugguggacagaggcuggggcaacggcugcggccuguucggcaagggcggcaucgugaccugcgccauguucaccugcaagaagaacauggagggcaagaucgugcagcccgagaaccuggaguacaccaucguggugaccccccacagcggcgaggagcacgccgugggcaacgacaccggcaagcacggcaaggagaucaaggugaccccccagagcagcaucaccgaggccgagcugaccggcuacggcaccgugaccauggagugcagccccagaaccggccuggacuucaacgagauggugcugcugcagauggagaacaaggccuggcuggugcacagacagugguuccuggaccugccccugcccuggcugcccggcgccgacaagcaggagagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucgugaucagagugcaguacgagggcgacggcagccccugcaagauccccuucgagaucauggaccuggagagaagauacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcaucgugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccaggaggagggcaucugcggcaucagaagcgugaccagacuggagaaccugauguggaagcagaucacccccgagcugaaccacauccuggccgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagcuacaaccagaccuuccugaucgacggccccgagaccgccgagugccccaacaccaacagagccuggaacagccuggagguggaggacuacggcuucggcguguucaccaccaacaucuggcugaagcugaaggagaagcaggacgccuucugcgacagcaagcugaugagcgccgccaucaaggacaacagagccgugcacgccgacaugggcuacuggaucgagagcgcccugaacgacaccuggaagaucgagaaggccagcuucaucgaggugaagaacugccacuggcccaagagccacacccuguggagcaacggcgugcuggagagcgagaugaucauccccaagaaccuggccggccccgugagccagcacaacuacagacccggcuaccacacccagaucgccggccccuggcaccugggcaagcuggagauggacuucgacuucugcgacggcaccaccgugaucgugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagguggacaacuucagccugggcgugcugggcauggcccuguuccuggaggagaugcugagaaccagagugggcaugaagcacgccauccugcugguggccgugagcuucgugacccugaucaccggcaacaugagcuucaaggaccugggcagagugguggugauggugggcgccaccauggccgacgacaucggcaugggcgugaccuaccuggcccugcuggccgccuucaaggugagacccaccuucgccgccggccugcugcugagaaagcugaccagcaaggagcugaugaugaccaccaucggcaucgugcugcugagccagagcaccauccccgagaccgugcuggagcugaccgacgcccuggcccugggcaugauggugcugaagaucgugagaaacauggagaaguaccagcuggccgugaccaucaugaccauccugugcgugcccaacgccgugauccugcagaacgccuggaaggugagcugcaccauccuggccguggugagcgugagcccccugcugcugaccagcagcagacagaagaccgacuggaucccccuggcccugaccaucaagggccugaaccccaccgccaucuuccugaccacccugagcagaaccaacaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccaccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggccuguuccccaucagcauccccaucaccgccgccgccugguaccugugggaggugaagaagcagagagccggcgugcugugggacgugcccagccccccccccaugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacaagggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucaucgacaagaagggcaagguggugggccuguacggcaacggcguggugaccagaagcggcgccuacgugagcgccaucgcccagaccgagaagagcaucgaggacaaccccgagaucgaggacgacaucuucagaaagagaagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucaucgacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaagauggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaagaccagagacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcagaggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucgccacccagcagcccgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggaccccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaugggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaucccccccgagaagugcgacacccugcugugcgacaucggcgagagcagccccaaccccaccguggaggccggcagaacccugagagugcugaaccugguggagaacuggcugaacaacaacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccagcggcaacaucgugagcagcgugaacaugaucagcagaaugcugaucaacagauucaccaugagacacaagaaggccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacgugcugcccaccgugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcagauucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacauggagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcguguucaagaacauccagcaccugaccgugaccgaggagguggccgugcagaacuggcuggccagagugggcagagagagacugagcagaauggccaucagcggcgacgacugcguggugaagccccuggacgacagauucgccaacgcccugaccgcccugaacgacaugggcaagaucagaaaggacauccagcagugggagcccagcaagggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugagagagaccgccugccugggcaagagcuacgcccagauguggagccugauguacuuccacagaagagaccugagacuggccgccaacgccaucugcagcgccgugcccagccacugggugcccaccagcagaaccaccuggagcauccacgccaagcacgaguggaugaccaccgaggacaugcugaccguguggaacaagguguggaucagagagaaccccuggauggaggacaagacccccguggagagcugggaggagauccccuaccugggcaagagagaggaccaguggugcggcagccugaucggccugaccagcagagccaccugggccaagaacauccaggccgccaucaaccaggugagaagccugaucggcaacgaggaguacaccgacuacaugcccagcaugaagagauucagaagagaggaggaggaggccggcgugcugugguga

SEQ ID NO: 17412 - RNA, 9876 nt, Artificial Sequence
  derived and/or modified CDS sequence (opt4) from DENV-2__EU660417__SS-prME
agcgccggcaugaucaucaugcugauccccaccgugauggccuuccaccugaccaccagaaacggcgagccccacaugaucgugggcauccaggagaagggcaagagccugcuguucaagaccgaggacggcgugaacaugugcacccugauggccauggaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgcccagagaaucgagaccuggauccugagacaccccggcuucaccaucauggccgccauccuggccuacaccaucggcaccacccacuuccagagagugcugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaaggaggagcaggacaagagauucgugugcaagcacagcaugguggacagaggcuggggcaacggcugcggccuguucggcaagggcggcaucgugaccugcgccauguucaccugcaagaagaacauggagggcaagaucgugcagcccgagaaccuggaguacaccaucguggugaccccccacagcggcgaggagcacgccgugggcaacgacaccggcaagcacggcaaggagaucaaggugaccccccagagcagcaucaccgaggccgagcugaccggcuacggcaccgugaccauggagugcagccccagaaccggccuggacuucaacgagauggugcugcugcagauggagaacaaggccuggcuggugcacagacagugguuccuggaccugccccugcccuggcugcccggcgccgacaagcaggagagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucgugaucagagugcaguacgagggcgacggcagccccugcaagauccccuucgagaucauggaccuggagagaagauacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcaucgugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccaggaggagggcaucugcggcaucagaagcgugaccagacuggagaaccugauguggaagcagaucacccccgagcugaaccacauccuggccgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagcuacaaccagaccuuccugaucgacggccccgagaccgccgagugccccaacaccaacagagccuggaacagccuggagguggaggacuacggcuucggcguguucaccaccaacaucuggcugaagcugaaggagaagcaggacgccuucugcgacagcaagcugaugagcgccgccaucaaggacaacagagccgugcacgccgacaugggcuacuggaucgagagcgcccugaacgacaccuggaagaucgagaaggccagcuucaucgaggugaagaacugccacuggcccaagagccacacccuguggagcaacggcgugcuggagagcgagaugaucauccccaagaaccuggccggccccgugagccagcacaacuacagacccggcuaccacacccagaucgccggccccuggcaccugggcaagcuggagauggacuucgacuucugcgacggcaccaccgugaucgugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagguggacaacuucagccugggcgugcugggcauggcccuguuccuggaggagaugcugagaaccagagugggcaccaagcacgccauccugcugguggccgugagcuucgugacccugaucaccggcaacaugagcuucaaggaccugggcagagugguggugauggugggcgccaccauggccgacgacaucggcaugggcgugaccuaccuggcccugcuggccgccuucaaggugagacccaccuucgccgccggccugcugcugagaaagcugaccagcaaggagcugaugaugaccaccaucggcaucgugcugcugagccagagcaccauccccgagaccgugcuggagcugaccgacgcccuggcccugggcaugauggugcugaagaucgugagaaacauggagaaguaccagcuggccgugaccaucaugaccauccugugcgugcccaacgccgugauccugcagaacgccuggaaggugagcugcaccauccuggccguggugagcgugagcccccugcugcugaccagcagcagacagaagaccgacuggaucccccuggcccugaccaucaagggccugaaccccaccgccaucuuccugaccacccugagcagaaccaacaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccaccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggccuguuccccaucagcauccccaucaccgccgccgccugguaccugugggaggugaagaagcagagagccggcgugcugugggacgugcccagccccccccccaugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacaagggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucaucgacaagaagggcaagguggugggccuguacggcaacggcguggugaccagaagcggcgccuacgugagcgccaucgcccagaccgagaagagcaucgaggacaaccccgagaucgaggacgacaucuucagaaagagaagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucaucgacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaagauggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaagaccagagacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcagaggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucgccacccagcagcccgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggaccccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcagccccggcagauucuggaacaccaccaucgccgugagcauggccaacaucuucagaggcagcuaccuggccggcgccggccugcuguucagcaucaugaagaacaccaccaacaccagaagaggcaccggcaacaugggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaucccccccgagaagugcgacacccugcugugcgacaucggcgagagcagccccaaccccaccguggaggccggcagaacccugagagugcugaaccugguggagaacuggcugaacaacaacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccagcggcaacaucgugagcagcgugaacaugaucagcagaaugcugaucaacagauucaccaugagacacaagaaggccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacgugcugcccaccgugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcagauucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacauggagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcguguucaagaacauccagcaccugaccgugaccgaggagguggccgugcagaacuggcuggccagagugggcagagagagacugagcagaauggccaucagcggcgacgacugcguggugaagccccuggacgacagauucgccaacgcccugaccgcccugaacgacaugggcaagaucagaaaggacauccagcagugggagcccagcaagggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugagagagaccgccugccugggcaagagcuacgcccagauguggagccugauguacuuccacagaagagaccugagacuggccgccaacgccaucugcagcgccgugcccagccacugggugcccaccagcagaaccaccuggagcauccacgccaagcacgaguggaugaccaccgaggacaugcugaccguguggaacaagguguggaucagagagaaccccuggauggaggacaagacccccguggagagcugggaggagauccccuaccugggcaagagagaggaccaguggugcggcagccugaucggccugaccagcagagccaccugggccaagaacauccaggccgccaucaaccaggugagaagccugaucggcaacgaggaguacaccgacuacaugcccagcaugaagagauucagaagagaggaggaggaggccggcgugcugugguga

SEQ ID NO: 17413 - RNA, 9876 nt, Artificial Sequence
  derived and/or modified CDS sequence (opt4) from DENV-2__EU677137__SS-prME
agcgccggcaugaucaucaugcugauccccaccgugauggccuuccaccugaccaccagaaacggcgagccccacaugaucgugggcauccaggagaagggcaagagccugcuguucaagaccgaggacggcgugaacaugugcacccugauggccauggaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgcccagagaaucgagaccuggauccugagacaccccggcuucaccaucauggccgccauccuggccuacaccaucggcaccacccacuuccagagagugcugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaaggaggagcaggacaagagauucgugugcaagcacagcaugguggacagaggcuggggcaacggcugcggccuguucggcaagggcggcaucgugaccugcgccauguucaccugcaagaagaacauggagggcaagaucgugcagcccgagaaccuggaguacaccaucguggugaccccccacagcggcgaggagcacgccgugggcaacgacaccggcaagcacggccaggagaucaaggugaccccccagagcagcaucaccgaggccgagcugaccggcuacggcaccgugaccauggagugcagccccagaaccggccuggacuucaacgagauggugcugcugcagauggagaacaaggccuggcuggugcacagacagugguuccuggaccugccccugcccuggcugcccggcgccgacaagcaggagagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucgugaucagagugcaguacgagggcgacggcagccccugcaagauccccuucgagaucauggaccuggagaagagauacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcaucgugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccaggaggagggcaucugcggcaucagaagcgugaccagacuggagaaccugauguggaagcagaucacccccgagcugaaccacauccuggccgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagcuacaaccagaccuuccugaucgacggccccgagaccgccgagugccccaacaccaacagagccuggaacagccuggagguggaggacuacggcuucggcguguucaccaccaacaucuggcugaagcugaaggagaagcaggacgccuucugcgacagcaagcugaugagcgccgccaucaaggacaacagagccgugcacgccgacaugggcuacuggaucgagagcgcccugaacgacaccuggaagaucgagaaggccagcuucaucgaggugaagaacugccacuggcccaagagccacacccuguggagcaacggcgugcuggagagcgagaugaucauccccaagaaccuggccggccccgugagccagcacaacuacagacccggcuaccacacccagaucgccggccccuggcaccugggcaagcuggagauggacuucgacuucugcgacggcaccaccgugaccgugaccgaggacugcggcagcagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagguggacaacuucagccugggcgugcugggcauggcccuguuccuggaggagaugcugagaaccagagugggcaccaagcacgccauccugcugguggccgugagcuucgugacccugaucaccggcaacaugagcuucaaggaccugggcagagugguggugauggugggcgccaccauggccgacgacaucggcaugggcgugaccuaccuggcccugcuggccgccuucaaggugagacccaccuucgccgccggccugcugcugagaaagcugaccagcaaggagcugaugaugaccaccaucggcaucgugcugcugagccagagcaccauccccgagaccgugcuggagcugaccgacgcccuggcccugggcaugauggugcugaagaucgugagaaacauggagaaguaccagcuggccgugaccaucauggccauccugugcgugcccaacgccgugauccugcagaacgccuggaaggugagcugcaccauccuggccguggugagcgugagcccccugcugcugaccagcagccagcagaagaccgacuggaucccccuggcccugaccgugaagggccugaaccccaccgccaucuuccugaccacccugagcagaaccaacaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccaccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggccuguuccccaucagcauccccaucaccgccgccgccugguaccugugggaggugaagaagcagagagccggcgugcugugggacgugcccagccccccccccaugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacaagggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucaucgacaagaagggcaagguggugggccuguacggcaacggcguggugaccagaagcggcgccuacgugagcgccaucgcccagaccgagaagagcaucgaggacaaccccgagaucgaggacgacaucuucagaaagagaagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucaucgacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaagauggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaagaccagagacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcagaggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucgccacccagcagcccgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggaccccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaugggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaucccccccgagaagugcgacacccugcugugcgacaucggcgagagcagccccaaccccaccguggaggccggcagaacccugagagugcugaaccugguggagaacuggcugaacaacaacacccaguucugcaucaaggugcugaaccccuacaugcccagcgugaucgagaagauggaggccaugcagagaaaguacggcggcgcccuggugagaaacccccugagcagaaacagcacccacgagauguacugggugagcaacgccagcggcaacaucgugagcagcgugaacaugaucagcagaaugcugaucaacagauucaccaugagacacaagaaggccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacgugcugcccaccgugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcagauucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacauggagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcguguucaagaacauccagcaccugaccgugaccgaggagguggccgugcagaacuggcuggccagagugggcagagagagacugagcagaauggccaucagcggcgacgacugcguggugaagccccuggacgacagauucgccaacgcccugaccgcccugaacgacaugggcaagaucagaaaggacauccagcagugggagcccagcaagggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugagagagaccgccugccugggcaagagcuacgcccagauguggagccugauguacuuccacagaagagaccugagacuggccgccaacgccaucugcagcgccgugcccagccacugggugcccaccagcagaaccaccuggagcauccacgccaagcacgaguggaugaccaccgaggacaugcugaccguguggaacagaguguggaucagagagaaccccuggauggaggacaagacccccguggagagcugggaggagauccccuaccugggcaagagagaggaccaguggugcggcagccugaucggccugaccagcagagccaccugggccaagaacauccaggccgccaucaaccaggugagaagccugaucggcaacgaggaguacaccgacuacaugcccagcaugaagagauucagaagagaggaggaggaggccggcgugcugugguga

SEQ ID NO: 17414 - RNA, 9876 nt, Artificial Sequence
  derived and/or modified CDS sequence (opt4) from DENV-2__EU677138__SS-prME
agcgccggcaugaucaucaugcugauccccaccgugauggccuuccaccugaccaccagaaacggcgagccccacaugaucgugggcauccaggagaagggcaagagccugcuguucaagaccgaggacggcgugaacaugugcacccugauggccauggaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgcccagagaaucgagaccuggauccugagacaccccggcuucaccaucauggccgccauccuggccuacaccaucggcaccacccacuuccagagagugcugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaaggaggagcaggacaagagauucgugugcaagcacagcaugguggacagaggcuggggcaacggcugcggccuguucggcaagggcggcaucgugaccugcgccauguucaccugcaagaagaacauggagggcaagaucgugcagcccgagaaccuggaguacaccaucguggugaccccccacagcggcgaggagcacgccgugggcaacgacaccggcaagcacggccaggagaucaaggugaccccccagagcagcaucaccgaggccgagcugaccggcuacggcaccgugaccauggagugcagccccagaaccggccuggacuucaacgagauggugcugcugcagauggagaacaaggccuggcuggugcacagacagugguuccuggaccugccccugcccuggcugcccggcgccgacaagcaggagagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucgugaucagagugcaguacgagggcgacggcagccccugcaagauccccuucgagaucauggaccuggagaagagauacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcaucgugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccaggaggagggcaucugcggcaucagaagcgugaccagacuggagaaccugauguggaagcagaucacccccgagcugaaccacauccuggccgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagcuacaaccagaccuuccugaucgacggccccgagaccgccgagugccccaacaccaacagagccuggaacagccuggagguggaggacuacggcuucggcguguucaccaccaacaucuggcugaagcugaaggagaagcaggacgccuucugcgacagcaagcugaugagcgccgccaucaaggacaacagagccgugcacgccgacaugggcuacuggaucgagagcgcccugaacgacaccuggaagaucgagaaggccagcuucaucgaggugaagaacugccacuggcccaagagccacacccuguggagcaacggcgugcuggagagcgagaugaucauccccaagaaccuggccggccccgugagccagcacaacuacagacccggcuaccacacccagaucgccggccccuggcaccugggcaagcuggagauggacuucgacuucugcgacggcaccaccgugaucgugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagguggacaacuucagccugggcgugcugggcauggcccuguuccuggaggagaugcugagaaccagagugggcaccaagcacgccauccugcugguggccgugagcuucgugacccugaucaccggcaacaugagcuucaaggaccugggcagagugguggugauggugggcgccaccauggccgacgacaucggcaugggcgugaccuaccuggcccugcuggccgccuucaaggugagacccaccuucgccgccggccugcugcugagaaagcugaccagcaaggagcugaugaugaccaccaucggcaucgugcugcugagccagagcaccauccccgagaccgugcuggagcugaccgacgcccuggcccugggcaugauggugcugaagaucgugagaaacauggagaaguaccagcuggccgugaccaucauggccauccugugcgugcccaacgccgugauccugcagaacgccuggaaggugagcugcaccauccuggccguggugagcgugagcccccugcugcugaccagcagccagcagaagaccgacuggaucccccuggcccugaccaucaagggccugaaccccaccgccaucuuccugaccacccugagcagaaccaacaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccaccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggccuguuccccaucagcauccccaucaccgccgccgccugguaccugugggaggugaagaagcagagagccggcgugcugugggacgugcccagccccccccccaugggcagagccgagcuggaggacggcgccuacagaaucaagcagaagggcauccugggcuacagccagaucggcgccggcguguacaaggagggcaccuuccacaccauguggcacgugaccagaggcgccgugcugaugcacaagggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucaucgacaagaagggcaagguggugggccuguacggcaacggcguggugaccagaagcggcgccuacgugagcgccaucgcccagaccgagaagagcaucgaggacaaccccgagaucgaggacgacaucuucagaaagagaagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucaucgacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaagauggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaagaccagagacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcagaggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucgccacccagcagcccgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggaccccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaugggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaucccccccgagaagugcgacacccugcugugcgacaucggcgagagcagccccaaccccaccguggaggccggcagaacccugagagugcugaaccugguggagaacuggcugaacaacaacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccagcggcaacaucgugagcagcgugaacaugaucagcagaaugcugaucaacagauucaccaugagacacaagaaggccaccuacgagcccgacguggaccugggcagcggcaccagaaacaucggcaucgagagcgagacccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacgugcugcccaccgugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcagauucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacauggagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcguguucaagaacauccagcaccugaccgccaccgaggagguggccgugcagaacuggcuggccagagugggcagagagagacugagcagaauggccaucagcggcgacgacugcguggugaagccccuggacgacagauucgccaacgcccugaccgcccugaacgacaugggcaagaucagaaaggacauccagcagugggagcccagcaagggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugagagagaccgccugccugggcaagagcuacgcccagauguggagccugauguacuuccacagaagagaccugagacuggccgccaacgccaucugcagcgccgugcccagccacugggugcccaccagcagaaccaccuggagcauccacgccaagcacgaguggaugaccaccgaggacaugcugaccguguggaacagaguguggaucagagagaaccccuggauggaggacaagacccccguggagagcugggaggagauccccuaccugggcaagagagaggaccaguggugcggcagccugaucggccugaccagcagagccaccugggccaagaacauccagguggccaucaaccaggugagaagccugaucggcaacgaggaguacaccgacuacaugcccagcaugaagagauucagaagagaggaggaggaggccggcgugcugugguga

SEQ ID NO: 17415 - RNA, 9876 nt, Artificial Sequence
  derived and/or modified CDS sequence (opt4) from DENV-2__EU677149__SS-prME
agcgccggcaugaucaucaugcugauccccaccgugauggccuuccaccugaccaccagaaacggcgagccccacaugaucgugggcauccaggagaagggcaagagccugcuguucaagaccgaggacggcgugaacaugugcacccugauggccauggaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgcccagagaaucgagaccuggauccugagacaccccggcuucaccaucauggccgccauccuggccuacaccaucggcaccacccacuuccagagagugcugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaaggaggagcaggacaagagauucgugugcaagcacagcaugguggacagaggcuggggcaacggcugcggccuguucggcaagggcggcaucgugaccugcgccauguucaccugcaagaagaacauggagggcaagaucgugcagcccgagaaccuggaguacaccaucguggugaccccccacagcggcgaggagcacgccgugggcaacgacaccggcaagcacggcaaggagaucaaggugaccccccagagcagcaucaccgaggccgagcugaccggcuacggcaccgugaccauggagugcagccccagaaccggccuggacuucaacgagauggugcugcugcagauggagaacaaggccuggcuggugcacagacagugguuccuggaccugccccugcccuggcugcccggcgccgacaagcaggagagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucgugaucagagugcaguacgagggcgacggcagccccugcaagauccccuucgagaucauggaccuggagagaagauacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcaucgugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccaggaggagggcaucugcggcaucagaagcgugaccagacuggagaaccugauguggaagcagaucacccccgagcugaaccacauccuggccgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagcuacaaccagaccuuccugaucgacggccccgagaccgccgagugccccaacaccaacagagccuggaacagccuggagguggaggacuacggcuucggcguguucaccaccaacaucuggcugaagcugaaggagaagcaggacgccuucugcgacagcaagcugaugagcgccgccaucaaggacaacagagccgugcacgccgacaugggcuacuggaucgagagcgcccugaacgacaccuggaagaucgagaaggccagcuucaucgaggugaagaacugccacuggcccaagagccacacccuguggagcaacggcgugcuggagagcgagaugaucauccccaagaaccuggccggccccgugagccagcacaacuacagacccggcuaccacacccagaucgccggccccuggcaccugggcaagcuggagauggacuucgacuucugcgacggcaccaccgugaucgugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagguggacaacuucagccugggcgugcugggcauggcccuguuccuggaggagaugcugagaaccagagugggcaccaagcacgccauccugcugguggccgugagcuucgugacccugaucaccggcaacaugagcuucaaggaccugggcagagugguggugauggugggcgccaccauggccgacgacaucggcaugggcgugaccuaccuggcccugcuggccgccuucaaggugagacccaccuucgccgccggccugcugcugagaaagcugaccagcaaggagcugaugaugaccaccaucggcaucgugcugcugagccagagcaccauccccgagaccgugcuggagcugaccgacgcccuggcccugggcaugauggugcugaagaucgugagaaacauggagaaguaccagcuggccgugaccaucaugaccauccugugcgugcccaacgccgugauccugcagaacgccuggaaggugagcugcaccauccuggccguggugagcgugagcccccugcugcugaccagcagcagacagaagaccgacuggaucccccuggcccugaccaucaagggccugaaccccaccgccaucuuccugaccacccugagcagaaccaacaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccaccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggccuguuccccaucagcauccccaucaccgccgccgccugguaccugugggaggugaagaagcagagagccggcgugcugugggacgugcccagccccccccccaugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacaagggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucaucgacaagaagggcaagguggugggccuguacggcaacggcguggugaccagaagcggcgccuacgugagcgccaucgcccagaccgagaagagcaucgaggacaaccccgagaucgaggacgacaucuucagaaagagaagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucaucgacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaagauggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaagaccagagacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcagaggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucgccacccagcagcccgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggaccccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaugggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaucccccccgagaagugcgacacccugcugugcgacaucggcgagagcagccccaaccccaccguggaggccggcagaacccugagagugcugaaccugguggagaacuggcugaacaacaacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccagcggcaacaucgugagcagcgugaacaugaucagcagaaugcugaucaacagauucaccaugagacacaagaaggccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacgugcugcccaccgugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcagauucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacauggagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcguguucaagaacauccagcaccugaccgugaccgaggagguggccgugcagaacuggcuggccagagugggcagagagagacugagcagaauggccaucagcggcgacgacugcguggugaagccccuggacgacagauucgccaacgcccugaccgcccugaacgacaugggcaagaucagaaaggacauccagcagugggagcccagcaagggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugagagagaccgccugccugggcaagagcuacgcccagauguggagccugauguacuuccacagaagagaccugagacuggccgccaacgccaucugcagcgccgugcccagccacugggugcccaccagcagaaccaccuggagcauccacgccaagcacgaguggaugaccaccgaggacaugcugaccguguggaacaagguguggaucagagagaaccccuggauggaggacaagacccccguggagagcugggaggagauccccuaccugggcaagagagaggaccaguggugcggcagccugaucggccugaccagcagagccaccugggccaagaacauccaggccgccaucaaccaggugagaagccugaucggcaacgaggaguacaccgacuacaugcccagcaugaagagauucagaagagaggaggaggaggccggcgugcugugguga

SEQ ID NO: 17416 - RNA, 9876 nt, Artificial Sequence
  derived and/or modified CDS sequence (opt4) from DENV-2__FJ024452__SS-prME
agcgccggcaugaucaucaugcugauccccaccgugauggccuuccaccugaccaccagaaacggcgagccccacaugaucgugggcauccaggagaagggcaagagccugcuguucaagaccgaggacggcgugaacaugugcacccugauggccauggaccugggcgagcugugcgaggacaccaucaccuacaagugcccccugcugagacagaacgagcccgaggacaucgacugcuggugcaacagcaccagcaccugggugaccuacggcaccugcaccaccaccggcggccacagaagagagaagagaagcguggcccuggugccccacgugggcaugggccuggagaccagaaccgagaccuggaugagcagcgagggcgccuggaagcacgcccagagaaucgagaccuggauccugagacaccccggcuucaccaucauggccgccauccuggccuacaccaucggcaccacccacuuccagagagugcugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaaggaggagcaggacaagagauucaucugcaagcacagcaugguggacagaggcuggggcaacggcugcggccuguucggcaagggcggcaucgugaccugcgccauguucaccugcaagaagaacauggagggcaagaucgugcagcccgagaaccuggaguacaccaucguggugaccccccacagcggcgaggagcacgccgugggcaacgacaccggcaagcacggcaaggagaucaaggugaccccccagagcagcaucaccgaggccgagcugaccggcuacggcaccgugaccauggagugcagccccagaaccggccuggacuucaacgagauggugcugcugcagauggagaacaaggccuggcuggugcacagacagugguuccuggaccugccccugcccuggcugcccggcgccgacaagcaggagagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucgugaucagagugcaguacgagggcgacggcagccccugcaagauccccuucgagaucauggaccuggagaagagauacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcaucgugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccaggaggagggcaucugcggcaucagaagcgugaccagacuggagaaccugauguggaagcagaucacccccgagcugaaccacauccuggccgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagcuacaaccagaccuuccugaucgacggccccgagaccgccgagugccccaacaccaacagagccuggaacagccuggagguggaggacuacggcuucggcguguucaccaccaacaucuggcugaagcugaaggagaagcaggacgccuucugcgacagcaagcugaugagcgccgccaucaaggacaacagagccgugcacgccgacaugggcuacuggaucgagagcgcccugaacgacaccuggaagaucgagaaggccagcuucaucgaggugaagaacugccacuggcccaagagccacacccuguggagcaacggcgugcuggagagcgagaugaucauccccaagaaccuggccggccccgugagccagcacaacuacagacccggcuaccacacccagaucgccggccccuggcaccugggcaagcuggagauggacuucgacuucugcgacggcaccaccgugaucgugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagguggacaacuucagccugggcgugcugggcauggcccuguuccuggaggagaugcugagaaccagagugggcaccaagcacgccauccugcugguggccgugagcuucgugacccugaucaccggcaacaugagcuucaaggaccugggcagagugguggugauggugggcgccaccauggccgacgacaucggcaugggcgugaccuaccuggcccugcuggccgccuucaaggugagacccaccuucgccgccggccugcugcugagaaagcugaccagcaaggagcugaugaugaccaccaucggcaucgugcugcugagccagagcaccauccccgagaccgugcuggagcugaccgacgcccuggcccugggcaugauggugcugaagaucgugagaaacauggagaaguaccagcuggccgugaccaucauggccauccugugcgugcccaacgccgugauccugcagaacgccuggaaggugagcugcaccauccuggccguggugagcgugagcccccugcugcugaccagcagccagcagaagaccgacuggaucccccuggcccugaccaucaagggccugaaccccaccgccaucuuccugaccacccugagcagaaccaacaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccaccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggccuguuccccaucagcauccccaucaccgccgccgccugguaccugugggaggugaagaagcagagagccggcgugcugugggacgugcccagccccccccccaugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacaagggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucaucgacaagaagggcaagguggugggccuguacggcaacggcguggugaccagaagcggcgccuacgugagcgccaucgcccagaccggcaagagcaucgaggacaaccccgagaucgaggacgacaucuucagaaagagaagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucaucgacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagaaucaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaagauggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaagaccagagacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcagaggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucgccacccagcagcccgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggaccccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaucccccccgagaagugcgacacccugcugugcgacaucggcgagagcagccccaaccccaccguggaggccggcagaacccugagagugcugaaccugguggagaacuggcugaacaacaacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccagcggcaacaucgugagcagcgugaacaugaucagcagaaugcugaucaacagauucaccaugagacacaagaaggccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacgugcugcccaccgugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcagauucugggagcugaucgacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacauggagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcguguucaagaacauccagcaccugaccgugaccgaggagguggccgugcagaacuggcuggccagagugggcagagagagacugagcagaauggccaucagcggcgacgacugcguggugaagccccuggacgacagauucgccaacgcccugaccgcccugaacgacaugggcaaggugagaaaggacauccagcagugggagcccagcaagggcuggaacgacuggacccaggugcccuucugcagccaccacuuccacgagcugaucaugaaggacggcagagugcugguggugcccugcagaaaccaggacgagcugaucgccagagccagaaucagccagggcgccggcuggagccugagagagaccgccugccugggcaagagcuacgcccagauguggagccugauguacuuccacagaagagaccugagacuggccgccaacgccaucugcagcgccgugcccagccacugggugcccaccagcagaaccaccuggagcauccacgccaagcacgaguggaugaccaccgaggacaugcugaccguguggaacagaguguggaucagagagaaccccuggauggaggacaagacccccguggagagcugggaggagauccccuaccugggcaagagagaggaccaguggugcggcagccugaucggccugaccagcagagccaccugggccaagaacauccaggccgccaucaaccaggugagaagccugaucggcaacgaggaguacaccgacuacaugcccagcaugaagagauucagaagagaggaggaggaggccggcgugcugugguga

SEQ ID NO: 17417 - RNA, 9876 nt, Artificial Sequence
  derived and/or modified CDS sequence (opt4) from DENV-2__FJ205877__SS-prME
agcgccggcaugaucaucaugcugauccccaccgugauggccuuccaccugaccaccagaaacggcgagccccacaugaucgugggcauccaggagaagggcaagagccugcuguucaagaccgaggacggcgugaacaugugcacccugauggccauggaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgcccagagaaucgagaccuggauccugagacaccccggcuucaccaucauggccgccauccuggccuacaccaucggcaccacccacuuccagagagugcugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaaggaggagcaggacaagagauucgugugcaagcacagcaugguggacagaggcuggggcaacggcugcggccuguucggcaagggcggcaucgugaccugcgccauguucaccugcaagaagaacauggagggcaagaucgugcagcccgagaaccuggaguacaccaucguggugaccccccacagcggcgaggagcacgccgugggcaacgacaccggcaagcacggcaaggagaucaaggugaccccccagagcagcaucaccgaggccgagcugaccggcuacggcaccgugaccauggagugcagccccagaaccggccuggacuucaacgagauggugcugcugcagauggagaacaaggccuggcuggugcacagacagugguuccuggaccugccccugcccuggcugcccggcgccgacaagcaggagagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucgugaucagagugcaguacgagggcgacggcagccccugcaagauccccuucgagaucauggaccuggagagaagauacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcaucgugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccaggaggagggcaucugcggcaucagaagcgugaccagacuggagaaccugauguggaagcagaucacccccgagcugaaccacauccuggccgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagcuacaaccagaccuuccugaucgacggccccgagaccgccgagugccccaacaccaacagagccuggaacagccuggagguggaggacuacggcuucggcguguucaccaccaacaucuggcugaagcugaaggagaagcaggacgccuucugcgacagcaagcugaugagcgccgccaucaaggacaacagagccgugcacgccgacaugggcuacuggaucgagagcgcccugaacgacaccuggaagaucgagaaggccagcuucaucgaggugaagaacugccacuggcccaagagccacacccuguggagcaacggcgugcuggagagcgagaugaucauccccaagaaccuggccggccccgugagccagcacaacuacagacccggcuaccacacccagaucgccggccccuggcaccugggcaagcuggagauggacuucgacuucugcgacggcaccaccgugaucgugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagguggacaacuucagccugggcgugcugggcauggcccuguuccuggaggagaugcugagaaccagagugggcaccaagcacgccauccugcugguggccgugagcuucgugacccugaucaccggcaacaugagcuucaaggaccugggcagagugguggugauggugggcgccaccauggccgacgacaucggcaugggcgugaccuaccuggcccugcuggccgccuucaaggugagacccaccuucgccgccggccugcugcugagaaagcugaccagcaaggagcugaugaugaccaccaucggcaucgugcugcugagccagagcaccauccccgagaccgugcuggagcugaccgacgcccuggcccugggcaugauggugcugaagaucgugagaaacauggagaaguaccagcuggccgugaccaucaugaccauccugugcgugcccaacgccgugauccugcagaacgccuggaaggugagcugcaccauccuggccguggugagcgugagcccccugcugcugaccagcagcagacagaagaccgacuggaucccccuggcccugaccaucaagggccugaaccccaccgccaucuuccugaccacccugagcagaaccaacaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccaccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggccuguuccccaucagcauccccaucaccgccgccgccugguaccugugggaggugaagaagcagagagccggcgugcugugggacgugcccagccccccccccaugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacaagggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucaucgacaagaagggcaagguggugggccuguacggcaacggcguggugaccagaagcggcgccuacgugagcgccaucgcccagaccgagaagagcaucgaggacaaccccgagaucgaggacgacaucuucagaaagagaagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucaucgacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuaccccgacagaagauggugcuucgacggcaucaagaacaaccagauccuggaggagaacguggagguggagaucuggcccaaggagggcgagagaaagaagcugaagcccagauggcuggaccccagaaucuacagcgagcccagagcccugaaggaguucaaggaguucccccccggcagaaagagccugacccugaaccugaucaccgagaugggcagacugcccaccuucaugacccagaagaccagagacgcccuggacaaccuggccggccugcacaccgccgaggccggcggcagagccgacaaccacgcccugagcgagcuggccgagacccuggagacccugcugcugcugacccugcuggccaccggcaccggcggcaucuuccuguuccugaugagcggcagaggcaucggcaagaugacccugggcaugugcugcaucaucaccgccagcauccugcugugggacgcccagauccagccccacuggaucgccgccagcaucauccuggaguucuuccugaucgugcugcugauccccgagcccgagaagcagagaaccccccaggacaaccagcugaccuacguggugaucgccauccugaccguggugggcgccaccaugcccaacgagaugggcuuccuggagaagaccaagaaggaccugggccugggcagcaucgccacccagcagcccgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcugggcccuggccaagauggacaucggcgugccccugcugggcaucggcugcuacagccaggugaaccccaucacccugaccggcgcccugcugcugcugggcggccacuacgccaucaucggccccggccugcaggccaaggccaccagagaggcccagaagagagccgcccccggcaucaugaagaaccccaccguggacggcaucaccgugaucgaccuggaccccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaugggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcgccagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaucccccccgagaagugcgacacccugcugugcgacaucggcgagagcagccccaaccccaccguggaggccggcagaacccugagagugcugaaccugguggagaacuggcugaacaacaacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccagcggcaacaucgugagcagcgugaacaugaucagcagaaugcugaucaacagauucaccaugagacacaagaaggccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacgugcugcccaccgugacccagauggccaugaccgacaccacccccuucggccagcagagaguguucaaggagaagguggacaccagaacccaggaccccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcagauucugggagcugguggacaaggagagaaaccugcaccuggagggcaagugcgagaccugcguguacaacaugaugggcaagagagagaagaagcugggcgaguucggcaaggccaaggccagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacauggagggcgagcacaagaagcuggccgaggccaucuucaagcugaccuaccagaacaagguggugagagugcagagacccacccccagaggcaccgugauggacaucaucagcagaagagaccagagaggcagcggccagguggccaccuacggccugaacaccuucaccaacauggaggcccagcugaucagacagauggagggcgagggcguguucaagaacauccagcaccugaccgugaccgaggagguggccgugcagaacuggcuggccagagugggcagagagagacugcccagaauggccaucagcggcgacgacugcguggugaagccccuggacgccagauucgccaacgcccugaccgcccugaacgccaugggcaagaucagaaaggacauccagcagugggagcccagcaagggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugagagagaccgccugccugggcaagagcuacgcccagauguggagccugauguacuuccacagaagagaccugagacuggccgccaacgccaucugcagcgccgugcccagccacugggugcccaccagcagaaccaccuggagcauccacgccaagcacgaguggaugaccaccgaggacaugcugaccguguggaacaagguguggaucagagagaaccccuggauggaggacaagacccccguggagagcugggaggagauccccuaccugggcaagagagaggaccaguggugcggcagccugaucggccugaccagcagagccaccugggccaagaacauccaggccgccaucaaccaggugagaagccugaucggcaacgaggaguacaccgacuacaugcccagcaugaagagauucagaagagaggaggaggaggccggcgugcugugguga

SEQ ID NO: 17418 - RNA, 9876 nt, Artificial Sequence
  derived and/or modified CDS sequence (opt4) from DENV-2__FJ024454__SS-prME
agcgccggcaugaucaucaugcugauccccaccgugauggccuuccaccugaccaccagaaacggcgagccccacaugaucgugggcauccaggagaagggcaagagccugcuguucaagaccgaggacggcgugaacaugugcacccugauggccauggaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgcccagagaaucgagaccuggauccugagacaccccggcuucaccaucauggccgccauccuggccuacaccaucggcaccacccacuuccagagagugcugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaaggaggagcaggacaagagauucgugugcaagcacagcaugguggacagaggcuggggcaacggcugcggccuguucggcaagggcggcaucgugaccugcgccauguucaccugcaagaagaacauggagggcaagaucgugcagcccgagaaccuggaguacaccaucguggugaccccccacagcggcgaggagcacgccgugggcaacgacaccggcaagcacggccaggagaucaaggugaccccccagagcagcaucaccgaggccgagcugaccggcuacggccccgugaccauggagugcagccccagaaccggccuggacuucaacgagauggugcugcugcagauggagaacaaggccuggcuggugcacagacagugguuccuggaccugccccugcccuggcugcccggcgccgacaagcaggagagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucgugaucagagugcaguacgagggcgacggcagccccugcaagauccccuucgagaucauggaccuggagaagagauacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcaucgugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccaggaggagggcaucugcggcaucagaagcgugaccagacuggagaaccugauguggaagcagaucacccccgagcugaaccacauccuggccgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagcuacaaccagaccuuccugaucgacggccccgagaccgccgagugccccaacaccaacagagccuggaacagccuggagguggaggacuacggcuucggcguguucaccaccaacaucuggcugaagcugaaggagaagcaggacgccuucugcgacagcaagcugaugagcgccgccaucaaggacaacagagccgugcacgccgacaugggcuacuggaucgagagcgcccugaacgacaccuggaagaucgagaaggccagcuucaucgaggugaagaacugccacuggcccaagagccacacccuguggagcaacggcgugcuggagagcgagaugaucauccccaagaaccuggccggccccgugagccagcacaacuacagacccggcuaccacacccagaucgccggccccuggcaccugggcaagcuggagauggacuucgacuucugcgacggcaccaccgugaucgugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagguggacaacuucagccugggcgugcugggcauggcccuguuccuggaggagaugcugagaaccagagugggcaccaagcacgccauccugcugguggccgugagcuucgugacccugaucaccggcaacaugagcuucaaggaccugggcagagugguggugauggugggcgccaccauggccgacgacaucggcaugggcgugaccuaccuggcccugcuggccgccuucaaggugagacccaccuucgccgccggccugcugcugagaaagcugaccagcaaggagcugaugaugaccaccaucggcaucgugcugcugagccagagcaccauccccgagaccgugcuggagcugaccgacgcccuggcccugggcaugauggugcugaagaucgugagaaacauggagaaguaccagcuggccgugaccaucauggccauccugugcgugcccaacgccgugauccugcagaacgccuggaaggugagcugcaccauccuggccguggugagcgugagcccccugcugcugaccagcagccagcagaagaccgacuggaucccccuggcccugaccaucaagggccugaaccccaccgccaucuuccugaccacccugagcagaaccaacaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccaccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggccuguuccccaucagcauccccaucaccgccgccgccugguaccugugggaggugaagaagcagagagccggcgugcugugggacgugcccagccccccccccaugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacaagggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucaucgacaagaagggcaagguggugggccuguacggcaacggcguggugaccagaagcggcgccuacgugagcgccaucgcccagaccgagaagagcaucgagaacaaccccgagaucgaggacgacaucuucagaaagagaagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucaucgacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaagauggugcuucgacggcaucaagaacaaccagauccuggaggagaacguggagguggagaucuggcccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaagaccagagacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcagaggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucgccacccagcagcccgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggaccccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaugggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaucccccccgagaagugcgacacccugcugugcgacaucggcgagagcagccccaaccccaccguggaggccggcagaacccugagagugcugaaccugguggagaacuggcugaacaacaacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccagcggcaacaucgugagcagcgugaacaugaucagcagaaugcugaucaacagauucaccaugagacacaagaaggccaccuacgagcccgacguggaccugggcagcggcaccagaaacaucggcaucgagagcgagacccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaccggcguggugagacugcugaccaagcccugggacgugcugcccaccgugacccagauggccaugaccgacaccacccccuucggccagcagagaguguucaaggagaagguggacaccagaacccaggaccccaaggaggccaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcagauucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacauggagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcguguucaagaacauccagcaccugcccgugaccgaggagguggccgugcagaacuggcuggccagagugggcagagagagacugagcagaaugcccaucagcggcgacgacugcguggugaagccccuggacgccagauuccccaccgcccugaccccccugaacgacaugggcaagaucagaaaggacauccaccagugggaccccagcaagggcuggaacgacuggacccaggugcccuucugcagccaccacuuccacgagcugaucaugaaggacggcagagugcugguggugcccugcagaaaccaggacgaccugaucgccagagccagaaucagccagggccccggcuggagccugagagagaccgccugccugggcaagagcuacgcccagauguggagccugauguacuuccacagaagagaccugagacuggccgccaacgccaucugcagcgccgugcccagccacugggugcccaccagcagaaccaccuggagcauccacgccaagcacgaguggaugaccaccgaggacaugcugaccguguggaacagaguguggaucagagagaaccccuggauggaggacaagacccccguggagagcugggaggagauccccuaccugggcaagagagaggaccaguggugcggcagccugaucggccugaccagcagagccaccugggccaagaacauccagguggccaucaaccaggugagaagccugaucggcaacgaggaguacaccgacuacaugcccagcaugaagagauucagaagagaggaggaggaggccggcgugcugugguga

SEQ ID NO: 17419 - RNA, 9876 nt, Artificial Sequence
  derived and/or modified CDS sequence (opt4) from DENV-2__FJ205878__SS-prME
agcgccggcaugaucaucaugcugauccccaccgugaccgccuuccaccugaccaccagaaacggcgagccccacaugaucgugggcauccaggagaagggcaagagccugcuguucaagaccgaggacggcgugaacaugugcacccugauggccauggaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgcccagagaaucgagaccuggauccugagacaccccggcuucaccaucauggccgccauccuggccuacaccaucggcaccacccacuuccagagagugcugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaaggaggagcaggacaagagauucgugugcaagcacagcaugguggacagaggcuggggcaacggcugcggccuguucggcaagggcggcaucgugaccugcgccauguucaccugcaagaagaacauggagggcaagaucgugcagcccgagaaccuggaguacaccaucguggugaccccccacagcggcgaggagcacgccgugggcaacgacaccggcaagcacggccaggagaucaaggugaccccccagagcagcaucaccgaggccgagcugaccggcuacggcaccgugaccauggagugcagccccagaaccggccuggacuucaacgagauggugcugcugcagauggagaacaaggccuggcuggugcacagacagugguuccuggaccugccccugcccuggcugcccggcgccgacaagcaggagagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucgugaucagagugcaguacgagggcgacggcagccccugcaagauccccuucgagaucauggaccuggagaagagauacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcaucgugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccaggaggagggcaucugcggcaucagaagcgugaccagacuggagaaccugauguggaagcagaucacccccgagcugaaccacauccuggccgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagcuacaaccagaccuuccugaucgacggccccgagaccgccgagugccccaacaccaacagagccuggaacagccuggagguggaggacuacggcuucggcguguucaccaccaacaucuggcugaagcugaaggagaagcaggacgccuucugcgacagcaagcugaugagcgccgccaucaaggacaacagagccgugcacgccgacaugggcuacuggaucgagagcgcccugaacgacaccuggaagaucgagaaggccagcuucaucgaggugaagaacugccacuggcccaagagccacacccuguggagcaacggcgugcuggagagcgagaugaucauccccaagaaccuggccggccccgugagccagcacaacuacagacccggcuaccacacccagaucgccggccccuggcaccugggcaagcuggagauggacuucgacuucugcgacggcaccaccgugaucgugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagguggacaacuucagccugggcgugcugggcauggcccuguuccuggaggagaugcugagaaccagagugggcaccaagcacgccauccugcugguggccgugagcuucgugacccugaucaccggcaacaugagcuucaaggaccugggcagagugguggugauggugggcgccaccaugaccgacgacaucggcaugggcgugaccuaccuggcccugcuggccgccuucaaggugagacccaccuucgccgccggccugcugcugagaaagcugaccagcaaggagcugaugaugaccaccaucggcaucgugcugcugagccagagcaccauccccgagaccgugcuggagcugaccgacgcccuggcccugggcaugauggugcugaagaucgugagaaacauggagaaguaccagcuggccgugaccaucauggccauccugugcgugcccaacgccgugauccugcagaacgccuggaaggugagcugcaccauccuggccguggugagcgugagcccccugcugcugaccagcagccagcagaagaccgacuggaucccccuggcccugaccaucaagggccugaaccccaccgccaucuuccugaccacccugagcagaaccaacaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccaccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggccuguuccccaucagcauccccaucaccgccgccgccugguaccugugggaggugaagaagcagagagccggcgugcugugggacgugcccagccccccccccaugggcaaggccgagcuggaggacggcgccuacagaaucaagcagaagggcauccugggcuacagccagaucggcgccggcguguacagagagggcaccuuccacaccauguggcacgugaccagaggcgccgugcugaugcacaagggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucaucgacaagaagggcaagguggugggccuguacggcaacggcguggugaccagaagcggcgccuacgugagcgccaucgcccagaccgagaagagcaucgaggacaaccccgagaucgaggacgacaucuucagaaagagaagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucaucgacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaagauggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaagaccagagacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcagaggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucgccacccagcagcccgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggaccccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaugggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaucccccccgagaagugcgacacccugcugugcgacaucggcgagagcagccccaaccccaccguggaggccggcagaacccugagagugcugaaccugguggagaacuggcugaacaacaacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccagcggcaacaucgugagcagcgugaacaugaucagcagaaugcugaucaacagauucaccaugagacacaagaaggccaccuacgagcccgacguggaccugggcagcggcaccagaaacaucggcaccgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacgugcugcccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcagauucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacauggagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcguguucaagaacauccagcaccugaccgugaccgaggagguggccgugaagaacuggcuggccagagugggcagagagagacugagcagaauggccaucagcggcgacgacugcguggugaagccccuggacgacagauucgccaacgcccugaccgcccugaacgacaugggcaagaucagaaaggacauccagcagugggagcccagcaagggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugagagagaccgccugccugggcaagagcuacgcccagauguggagccugauguacuuccacagaagagaccugagacuggccgccaacgccaucugcagcgccgugcccagccacugggugcccaccagcagaaccaccuggagcauccacgccaagcacgaguggaugaccaccgaggacaugcugaccguguggaacagaguguggaucagagagaaccccuggauggaggacaagacccccguggagagcugggaggagauccccuaccugggcaagagagaggaccaguggugcggcagccugaucggccugaccagcagagccaccugggccaagaacauccaggccgccaucaaccaggugagaagccugaucggcaacgaggaguacaccgacuacaugcccagcaugaagagauucagaagagaggaggaggaggccggcgugcugugguga

SEQ ID NO: 17420 - RNA, 9876 nt, Artificial Sequence
  derived and/or modified CDS sequence (opt4) from DENV-2__FJ205879__SS-prME
agcgccggcaugaucaucaugcugauccccaccgugauggccuuccaccugaccaccagaaacggcgagccccacaugaucgugggcauccaggagaagggcaagagccugcuguucaagaccgaggacggcgugaacaugugcacccugauggccauggaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgcccagagaaucgagaccuggauccugagacaccccggcuucaccaucauggccgccauccuggccuacaccaucggcaccacccacuuccagagagugcugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaaggaggagcaggacaagagauucaucugcaagcacagcaugguggacagaggcuggggcaacggcugcggccuguucggcaagggcggcaucgugaccugcgccauguucaccugcaagaagaacauggagggcaagaucgugcagcccgagaaccuggaguacaccaucguggugaccccccacagcggcgaggagcacgccgugggcaacgacaccggcaagcacggcaaggagaucaaggugaccccccagagcagcaucaccgaggccgagcugaccggcuacggcaccgugaccauggagugcagccccagaaccggccuggacuucaacgagauggugcugcugcagauggagaacaaggccuggcuggugcacagacagugguuccuggaccugccccugcccuggcugcccggcgccgacaagcaggagagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucgugaucagagugcaguacgagggcgacggcagccccugcaagauccccuucgagaucauggaccuggagaagagauacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcaucgugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccaggaggagggcaucugcggcaucagaagcgugaccagacuggagaaccugauguggaagcagaucacccccgagcugaaccacauccuggccgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagcuacaaccagaccuuccugaucgacggccccgagaccgccgagugccccaacaccaacagagccuggaacagccuggagguggaggacuacggcuucggcguguucaccaccaacaucuggcugaagcugaaggagaagcaggacgccuucugcgacagcaagcugaugagcgccgccaucaaggacaacagagccgugcacgccgacaugggcuacuggaucgagagcgcccugaacgacaccuggaagaucgagaaggccagcuucaucgaggugaagaacugccacuggcccaagagccacacccuguggagcaacggcgugcuggagagcgagaugaucauccccaagaaccuggccggccccgugagccagcacaacuacagacccggcuaccacacccagaucgccggccccuggcaccugggcaagcuggagauggacuucgacuucugcgacggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagguggacaacuucagccugggcgugcugggcauggcccuguuccuggaggagaugcugagaaccagagugggcaccaagcacgccauccugcugguggccgugagcuucgugacccugaucaccggcaacaugagcuucaaggaccugggcagagugguggugauggugggcgccaccauggccgacgacaucggcaugggcgugaccuaccuggcccugcuggccgccuucaaggugagacccaccuucgccgccggccugcugcugagaaagcugaccagcaaggagcugaugaugaccaccaucggcaucgugcugcugagccagagcaccauccccgagaccgugcuggagcugaccgacgcccuggcccugggcaugauggugcugaagaucgugagaaacauggagaaguaccagcuggccgugaccaucauggccauccugugcgugcccaacgccgugauccugcagaacgccuggaaggugagcugcaccauccuggccguggugagcgugagcccccugcugcugaccagcagccagcagaagaccgacuggaucccccuggcccugaccaucaagggccugaaccccaccgccaucuuccugaccacccugagcagaaccaacaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccaccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggccuguuccccaucagcauccccaucaccgccgccgccugguaccugugggaggugaagaagcagagagccggcgugcugugggacgugcccagccccccccccaugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacaagggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucaucgacaagaagggcaagguggugggccuguacggcaacggcguggugaccagaagcggcgccuacgugagcgccaucgcccagaccgagaagagcaucgaggacaaccccgagaucgaggacgacaucuucagaaagagaagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucaucgacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaagauggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaagaccagagacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcagaggcaucggcaagaugacccugggcaugugcugcaucaccaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucgccacccagcagcccgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggaccccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaaccccagaagaggcaccggcaacaugggcgagacccugggcgagaaguggaagagcagacugaacgcccugggcaagagcgaguuccagaucuacaagagaagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaucccccccgagaagugcgacacccugcugugcgacaucggcgagagcagccccaaccccaccguggaggccggcagaacccugagagugcugaaccugguggagaacuggcugaacaacaacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccagcggcaacaucgugagcagcgugaacaugaucagcagaaugcugaucaacagauucaccaugagacacaagaaggccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacgugcugcccaccgugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcagauucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacauggagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcguguucaagaacauccagcaccugaccgugaccgaggagguggccgugcagaacuggcuggccagagugggcagagagagacugagcagaauggccaucagcggcgacgacugcguggugaagccccuggacgacagauucgccaacgcccugaccgcccugaacgacaugggcaagaucagaaaggacauccagcagugggagcccagcaagggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugagagagaccgccugccugggcaagagcuacgcccagauguggagccugauguacuuccacagaagagaccugagacuggccgccaacgccaucugcagcgccgugcccagccacugggugcccaccagcagaaccaccuggagcauccacgccaagcacgaguggaugaccaccgaggacaugcugaccguguggaacagaguguggaucagagagaaccccuggauggaggacaagacccccguggagagcugggaggagauccccuaccugggcaagagagaggaccaguggugcggcagccugaucggccugaccagcagagccaccugggccaagaacauccaggccgccaucaaccaggugagaagccugaucggcaacgaggaguacaccgacuacaugcccagcaugaagagauucagaagagaggaggaggaggccggcgugcugugguga

SEQ ID NO: 17421 - RNA, 9876 nt, Artificial Sequence
  derived and/or modified CDS sequence (opt4) from DENV-2__FJ390385__SS-prME
agcgccggcaugaucaucaugcugauccccaccgugauggccuuccaccugaccaccagaaacggcgagccccacaugaucgugggcauccaggagaagggcaagagccugcuguucaagaccgaggacggcgugaacaugugcacccugauggccauggaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgcccagagaaucgagaccuggauccugagacaccccggcuucaccaucauggccgccauccuggccuacaccaucggcaccacccacuuccagagagugcugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaaggaggagcaggacaagagauucgugugcaagcacagcaugguggacagaggcuggggcaacggcugcggccuguucggcaagggcggcaucgugaccugcgccauguucaccugcaagaagaacauggagggcaagaucgugcagcccgagaaccuggaguacaccaucguggugaccccccacagcggcgaggagcacgccgugggcaacgacaccggcaagcacggcaaggagaucaaggugaccccccagagcagcaucaccgaggccgagcugaccggcuacggcaccgugaccauggagugcagccccagaaccggccuggacuucaacgagauggugcugcugcagauggagaacaaggccuggcuggugcacagacagugguuccuggaccugccccugcccuggcugcccggcgccgacaagcaggagagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucgugaucagagugcaguacgagggcgacggcagccccugcaagauccccuucgagaucauggaccuggagaagagauacgugcugggcagacugaucaccgugaaccccaucgccaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcaucgugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccaggaggagggcaucugcggcaucagaagcgugaccagacuggagaaccugauguggaagcagaucacccccgagcugaaccacauccuggccgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagcuacaaccagaccuuccugaucgacggccccgagaccgccgagugccccaacaccaacagagccuggaacagccuggagguggaggacuacggcuucggcguguucaccaccaacaucuggcugaagcugaaggagaagcaggacgccuucugcgacagcaagcugaugagcgccgccaucaaggacaacagagccgugcacgccgacaugggcuacuggaucgagagcgcccugaacgacaccuggaagaucgagaaggccagcuucaucgaggugaagaacugccacuggcccaagagccacacccuguggagcaacggcgugcuggagagcgagaugaucauccccaagaaccuggccggccccgugagccagcacaacuacagacccggcuaccacacccagaucgccggccccuggcaccugggcaagcuggagauggacuucgacuucugcgacggcaccaccgugaucgugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagguggacaacuucagccugggcgugcugggcauggcccuguuccuggaggagaugcugagaaccagagugggcaccaagcacgccauccugcugguggccgugagcuucgugacccugaucaccggcaacaugagcuucaaggaccugggcagagugguggugauggugggcgccaccauggccgacgacaucggcaugggcgugaccuaccuggcccugcuggccgccuucaaggugagacccaccuucgccgccggccugcugcugagaaagcugaccagcaaggagcugaugaugaccaccaucggcaucgugcugcugagccagagcaccauccccgagaccgugcuggagcugaccgacgcccuggcccugggcaugauggugcugaagaucgugagaaacauggagaaguaccagcuggccgugaccaucauggccauccugugcgugcccaacgccgugauccugcagaacgccuggaaggugggcugcaccauccuggccguggugagcgugagcccccugcugcugaccagcagccagcagaagaccgacuggaucccccuggcccugaccaucaagggccugaaccccaccgccaucuuccugaccacccugagcagaaccaacaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccaccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggccuguuccccaucagcauccccaucaccgccgccgccugguaccugugggaggugaagaagcagagagccggcgugcugugggacgugcccagccccccccccaugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacaagggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucaucgacaagaagggcaagguggugggccuguacggcaacggcguggugaccagaagcggcgccuacgugagcgccaucgcccagaccgagaagagcaucgaggacaaccccgagaucgaggacgacaucuucagaaagagaagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagaagcgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucaucgacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaagauggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaagaccagagacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcagaggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucgccacccagcagcccgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggaccccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaugggcgagacccugggcgagaaguggaagagcagacugaacgcccugggcaagagcgaguuccagaucuacaagagaagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaucccccccgagaagugcgacacccugcugugcgacaucggcgagagcagccccaaccccaccguggaggccggcagaacccugagagugcugaaccugguggagaacuggcugaacaacaacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccagcggcaacaucgugagcagcgugaacaugaucagcagaaugcugaucaacagauucaccaugagacacaagaaggccaccuacgagcccgacguggaccugggcagcggcaccagaaacaucggcaccgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacgugcugcccaccgugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcagauucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacaugaagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcguguucaagaacauccagcaccugaccgugaccgaggagguggccgugcagaacuggcuggccagagugggcagagagagacugagcagaauggccaucagcggcgacgacugcguggugaagccccuggacgacagauucgccaacgcccugaccgcccugaacgacaugggcaagaucagaaaggacauccagcagugggagcccagcaagggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugagagagaccgccugccugggcaagagcuacgcccagauguggagccugauguacuuccacagaagagaccugagacuggccgccaacgccaucugcagcgccgugcccagccacugggugcccaccagcagaaccaccuggagcauccacgccaagcacgaguggaugaccaccgaggacaugcugaccguguggaacagaguguggaucagagagaaccccuggauggaggacaagacccccguggagagcugggaggagauccccuaccugggcaagagagaggaccaguggugcggcagccugaucggccugaccagcagagccaccugggccaagaacauccaggccgccaucaaccaggugagaagccugaucggcaacgaggaguacaccgacuacaugcccagcaugaagagauucagaagagaggaggaggaggccggcgugcugugguga

SEQ ID NO: 17422 - RNA, 9876 nt, Artificial Sequence
  derived and/or modified CDS sequence (opt4) from DENV-2__FJ024458__SS-prME
agcgccggcaugaucaucaugcugauccccaccgugauggccuuccaccugaccaccagaaacggcgagccccacaugaucgugggcauccaggagaagggcaagagccugcuguucaagaccgaggacggcgugaacaugugcacccugauggccauggaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgcccagagaaucgagaccuggauccugagacaccccggcuucaccaucauggccgccauccuggccuacaccaucggcaccacccacuuccagagagugcugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaaggaggagcaggacaagagauucgugugcaagcacagcaugguggacagaggcuggggcaacggcugcggccuguucggcaagggcggcaucgugaccugcgccauguucaccugcaagaagaacauggagggcaagaucgugcagcccgagaaccuggaguacaccaucguggugaccccccacagcggcgaggagcacgccgugggcaacgacaccggcaagcacggcaaggagaucaaggugaccccccagagcagcaucaccgaggccgagcugaccggcuacggcaccgugaccauggagugcagccccagaaccggccuggacuucaacgagauggugcugcugcagauggagaacaaggccuggcuggugcacagacagugguuccuggaccugccccugcccuggcugcccggcgccgacaagcaggagagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucgugaucagagugcaguacgagggcgacggcagccccugcaagauccccuucgagaucauggaccuggagaagagauacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcaucgugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccaggaggagggcaucugcggcaucagaagcgugaccagacuggagaaccugauguggaagcagaucacccccgagcugaaccacauccuggccgagaacgaggugaagcugaccaucaugaccggcgacaucaagggcaucaugcaggccggcagaagaagccugagaccccagcccaccgagcugaaguacagcuggaagaccuggggcaaggccaagaugcugagcaccgagagcuacaaccagaccuuccugaucgacggccccgagaccgccgagugccccaacaccaacagagccuggaacagccuggagguggaggacuacggcuucggcguguucaccaccaacaucuggcugaagcugaaggagaagcaggacgccuucugcgacagcaagcugaugagcgccgccaucaaggacaacagagccgugcacgccgacauggacuacuggaucgagagcgcccugaacgacaccuggaagaucgagaaggccagcuucaucgaggugaagaacugccacugggccaagagccacacccuguggagcaacggcgugcuggagagcgagaugaucauccccaagaaccuggccggccccgugagccagcacaacuacagacugggcuaccacacccagaucgccggccccuggcaccugggcaagcuggagauggacuucgacuucugcgacggcaccaccgugaucgugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagguggacaacuucagccugggcgugcugggcauggcccuguuccuggaggagaugcugagaaccagagugggcaccaagcacgccauccugcugguggccgugagcuucgugacccugaucaccggcaacaugagcuucaaggaccugggcagagugguggugauggugggcgccaccauggccgacgacaucggcaugggcgugaccuaccuggcccugcuggccgccuucaaggugagacccaccuucgccgccggccugcugcugagaaagcugaccagcaaggagcugaugaugaccaccaucggcaucgugcugcugagccagagcaccauccccgagaccgugcuggagcugaccgacgcccuggcccugggcaugauggugcugaagaucgugagaaacauggagaaguaccagcuggccgugaccaucauggccauccugugcgugcccaacgccgugauccugcagaacgccuggaaggugagcugcaccauccuggccguggugagcgugagcccccugcugcugaccagcagccagcagaagaccgacuggaucccccuggcccugaccaucaagggccugaaccccaccgccaucuuccugaccacccugagcagaaccaacaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccaccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggccuguuccccaucagcauccccaucaccgccgccgccugguaccugugggaggugaagaagcagagagccggcgugcugugggacgugcccagccccccccccaugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacaagggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucaucgacaagaagggcaagguggugggccuguacggcaacggcguggugaccagaagcggcgccuacgugagcgccaucgcccagaccgagaagagcaucgaggacaaccccgagaucgaggacgacaucuucagaaagagaagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucaucgacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaagauggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaagaccagagacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcagaggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggacuucggccugggcagcaucgccacccagcagcccgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggaccccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaucccccccgagaagugcgacacccugcugugcgacaucggcgagagcagccccaaccccaccguggaggccggcagaacccugagagugcugaaccugguggagaacuggcugaacaacaacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccagcggcaacaucgugagcagcgugaacaugaucagcagaaugcugaucaacagauucaccaugagacacaagaaggccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacgugcugcccaccgugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcagauucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacauggagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcguguucaagaacauccagcaccugaccgugaccgaggagguggccgugcagaacuggcuggccagagugggcagagagagacugagcagaauggccaucagcggcgacgacugcguggugaagccccuggacgacagauucgccaacgcccugaccgcccugaacgacaugggcaagaucagaaaggacauccagcagugggagcccagcaagggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugagagagaccgccugccugggcaagagcuacgcccagauguggagccugauguacuuccacagaagagaccugagacuggccgccaacgccaucugcagcgccgugcccagccacugggugcccaccagcagaaccaccuggagcauccacgccaagcacgaguggaugaccaccgaggacaugcugaccguguggaacagaguguggaucagagagaaccccuggauggaggacaagacccccguggagagcugggaggagauccccuaccugggcaagagagaggaccaguggugcggcagccugaucggccugaccagcagagccaccugggccaagaacauccaggccgccaucaaccaggugagaagccugaucggcaacgaggaguacaccgacuacaugcccagcaugaagagauucagaagagaggaggaggaggccggcgugcugugguga

SEQ ID NO: 17423 - RNA, 9876 nt, Artificial Sequence
  derived and/or modified CDS sequence (opt4) from DENV-2__FJ205880__SS-prME
agcgccggcaugaucaucaugcugauccccaccgugauggccuuccaccugaccaccagaaacggcgagccccacaugaucgugggcauccaggagaagggcaagagccugcuguucaagaccgaggacggcgugaacaugugcacccugauggccauggaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgcccagagaaucgagaccuggauccugagacaccccggcuucaccaucauggccgccauccuggccuacaccaucggcaccacccacuuccagagagugcugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaaggaggagcaggacaagagauucgugugcaagcacagcaugguggacagaggcuggggcaacggcugcggccuguucggcaagggcggcaucgugaccugcgccauguucaccugcaagaagaacauggagggcaagaucgugcagcccgagaaccuggaguacaccaucguggugaccccccacagcggcgaggagcacgccgugggcaacgacaccggcaagcacggccaggagaucaaggugaccccccagagcagcaucaccgaggccgagcugaccggcuacggcaccgugaccauggagugcagccccagaaccggccuggacuucaacgagauggugcugcugcagauggagaacaaggccuggcuggugcacagacagugguuccuggaccugccccugcccuggcugcccggcgccgacaagcaggagagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucgugaucagagugcaguacgagggcgacggcagccccugcaagauccccuucgagaucauggaccuggagaagagauacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcaucgugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccaggaggagggcaucugcggcaucagaagcgugaccagacuggagaaccugauguggaagcagaucacccccgagcugaaccacauccuggccgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagcuacaaccagaccuuccugaucgacggccccgagaccgccgagugccccaacaccaacagagccuggaacagccuggagguggaggacuacggcuucggcguguucaccaccaacaucuggcugaagcugaaggagaagcaggacgccagcugcgacagcaagcugaugagcgccgccaucaaggacaacagagccgugcacgccgacaugggcuacuggaucgagagcgcccugaacgacaccuggaagaucgagaaggccagcuucaucgaggugaagaacugccacuggcccaagagccacacccuguggagcaacggcgugcuggagagcgagaugaucauccccaagaaccuggccggccccgugagccagcacaacuacagacccggcuaccacacccagaucgccggccccuggcaccugggcaagcuggagauggacuucgacuucugcgacggcaccaccgugaucgugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagguggacaacuucagccugggcgugcugggcauggcccuguuccuggaggagaugcugaagaccagagugggcaccaagcacgccauccugcugguggccgugagcuucgugacccugaucaccggcaacaugagcuucaaggaccugggcagagugguggugauggugggcgccaccauggccgacgacaucggcaugggcgugaccuaccuggcccugcuggccgccuucaaggugagacccaccuucgccgccggccugcugcugagaaagcugaccagcaaggagcugaugaugaccaccaucggcaucgugcugcugagccagagcaccauccccgagaccgugcuggagcugaccgacgcccuggcccugggcaugauggugcugaagaucgugagaaacauggagaaguaccagcuggccgugaccaucauggccauccugugcgugcccaacgccgugauccugcagaacgccuggaaggugagcugcaccauccuggccguggugagcgugagcccccugcugcugaccagcagccagcagaagaccgacuggaucccccuggcccugaccaucaagggccugaaccccaccgccaucuuccugaccacccugagcagaaccaacaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccaccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggccuguuccccaucagcauccccaucaccgccgccgccugguaccugugggaggugaagaagcagagagccggcgugcugugggacgugcccagccccccccccaugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacaagggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucaucgacaagaagggcaagguggugggccuguacggcaacggcguggugaccagaagcggcgccuacgugagcgccaucgcccagaccgagaagagcaucgaggacaaccccgagaucgaggacgacaucuucagaaagagaagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucaucgacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaagauggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaagaccagagacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcagaggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucgccacccagcagcccgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggaccccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaugggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaucccccccgagaagugcgacacccugcugugcgacaucggcgagagcagccccaaccccaccguggaggccggcagaacccugagagugcugaaccugguggagaacuggcugaacaacaacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccagcggcaacaucgugagcagcgugaacaugaucagcagaaugcugaucaacagauucaccaugagacacaagaaggccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacgugcugcccaccgugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcagauucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacauggagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcguguucaagaacauccagcaccugaccgugaccgaggagguggccgugcagaacuggcuggccagagugggcagagagagacugagcagaauggccaucagcggcgacgacugcguggugaagccccuggacgacagauucgccaacgcccugaccgcccugaacgacaugggcaagaucagaaaggacauccagcagugggagcccagcaagggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugagagagaccgccugccugggcaagagcuacgcccagauguggagccugauguacuuccacagaagagaccugagacuggccgccaacgccaucugcagcgccgugcccagccacugggugcccaccagcagaaccaccuggagcauccacgccaagcacgaguggaugaccaccgaggacaugcugaccguguggaacagaguguggaucagagagaaccccuggauggaggacaagacccccguggagagcugggaggagauccccuaccugggcaagagagaggaccaguggugcggcagccugaucggccugaccagcagagccaccugggccaagaacauccaggccgccaucaaccaggugagaagccugaucggcaacgaggaguacaccgacuacaugcccagcaugaagagauucagaagagaggaggaggaggccggcgugcugugguga

SEQ ID NO: 17424 - RNA, 9876 nt, Artificial Sequence
  derived and/or modified CDS sequence (opt4) from DENV-2__FJ390387__SS-prME
agcgccggcaugaucaucaugcugauccccaccgugauggccuuccaccugaccaccagaaacggcgagccccacaugaucgugggcauccaggagaagggcaagagccugcuguucaagaccgaggacggcgugaacaugugcacccugauggccauggaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgcccagagaaucgagaccuggauccugagacaccccggcuucaccaucauggccgccauccuggccuacaccaucggcaccacccacuuccagagagugcugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaaggaggagcaggacaagagauucgugugcaagcacagcaugguggacagaggcuggggcaacggcugcggccuguucggcaagggcggcaucgugaccugcgccauguucaccugcaagaagaacauggagggcaagaucgugcagcccgagaaccuggaguacaccaucguggugaccccccacagcggcgaggagcacgccgugggcaacgacaccggcaagcacggccaggagaucaaggugaccccccagagcagcaucaccgaggccgagcugaccggcuacggcaccgugaccauggagugcagccccagaaccggccuggacuucaacgagauggugcugcugcagauggagaacaaggccuggcuggugcacagacagugguuccuggaccugccccugcccuggcugcccggcgccgacaagcaggagagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucgugaucagagugcaguacgagggcgacggcagccccugcaaggugcccuucgagaucauggaccuggagaagagauacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcaucgugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccaggaggagggcaucugcggcaucagaagcgugaccagacuggagaaccugauguggaagcagaucacccccgagcugaaccacauccuggccgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagcuacaaccagaccuuccugaucgacggccccgagaccgccgagugccccaacaccaacagagccuggaacagccuggagguggaggacuacggcuucggcguguucaccaccaacaucuggcugaagcugaaggagaagcaggacgccuucugcgacagcaagcugaugagcgccgccaucaaggacaacagagccgugcacgccgacaugggcuacuggaucgagagcgcccugaacgacaccuggaagaucgagaaggccagcuucaucgaggugaagaacugccacuggcccaagagccacacccuguggagcaacggcgugcuggagagcgagaugaucauccccaagaaccuggccggccccgugagccagcacaacuacagacccggcuaccacacccagaucgccggccccuggcaccugggcaagcuggagauggacuucgacuucugcgacggcaccaccgugaucgugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagguggacaacuucagccugggcgugcugggcauggcccuguuccuggaggagaugcugagaaccagagugggcaccaagcacgccauccugcugguggccgugagcuucgugacccugaucaccggcaacaugagcuucaaggaccugggcagagugguggugauggugggcgccaccaugaccgacgacaucggcaugggcgugaccuaccuggcccugcuggccgccuucaaggugagacccaccuucgccgccggccugcugcugagaaagcugaccagcaaggagcugaugaugaccaccaucggcaucgugcugcugagccagagcaccauccccgagaccgugcuggagcugaccgacgcccuggcccugggcaugauggugcugaagaucgugagaaacauggagaaguaccagcuggccgugaccaucauggccauccugugcgugcccaacgccgugauccugcagaacgccuggaaggugagcugcaccauccuggccguggugagcgugagcccccugcugcugaccagcagccagcagaagaccgacuggaucccccuggcccugaccaucaagggccugaaccccaccgccaucuuccugaccacccugagcagaaccaacaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccaccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggccuguuccccaucagcauccccaucaccgccgccgccugguaccugugggaggugaagaagcagagagccggcgugcugugggacgugcccagccccccccccaugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacaagggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucaucgacaagaagggcaagguggugggccuguacggcaacggcguggugaccagaagcggcgccuacgugagcgccaucgcccagaccgagaagagcaucgaggacaaccccgagaucgaggacgacaucuucagaaagagaagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucaucgacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaagauggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaagaccagagacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcagaggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucgccacccagcagcccgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggaccccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaugggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaucccccccgagaagugcgacacccugcugugcgacaucggcgagagcagccccaaccccaccguggaggccggcagaacccugagagugcugaaccugguggagaacuggcugaacaacaacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccagcggcaacaucgugagcagcgugaacaugaucagcagaaugcugaucaacagauucaccaugagacacaagaaggccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacgugcugcccaccgugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcagauucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacauggagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcguguucaagaacauccagcaccugaccgugaccgaggagguggccgugaagaacuggcuggccagagugggcagagagagacugagcagaauggccaucagcggcgacgacugcguggugaagccccuggacgacagauucgccaacgcccugaccgcccugaacgacaugggcaagaucagaaaggacauccagcagugggagcccagcaagggcuggaacgacuggacccaggugcccuucugcagccaccacuuccacgagcugaucaugaaggacggcagagugcugguggugcccugcagaaaccaggacgagcuggugggcagagccagaaucagccagggcgccggcuggagccugagagagaccgccugccugggcaagagcuacgcccagauguggagccugauguacuuccacagaagagaccugagacuggccgccaacgccaucugcagcgccgugcccagccacugggugcccaccagcagaaccaccuggagcauccacgccaagcacgaguggaugaccaccgaggacaugcugaccguguggaacagaguguggaucagagagaaccccuggauggaggacaagacccccguggagagcugggaggagauccccuaccugggcaagagagaggaccaguggugcggcagccugaucggccugaccagcagagccaccugggccaagaacauccaggccgccaucaaccaggugagaagccugaucggcaacgaggaguacaccgacuacaugcccagcaugaagagauucagaagagaggaggaggaggccggcgugcugugguga

SEQ ID NO: 17425 - RNA, 9876 nt, Artificial Sequence
  derived and/or modified CDS sequence (opt4) from DENV-2__FJ024461__SS-prME
agcgccggcaugaucaucaugcugauccccaccgugauggccuuccaccugaccaccagaaacggcgagccccacaugaucgugggcauccaggagaagggcaagagccugcuguucaagaccgaggacggcgugaacaugugcacccugauggccauggaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgcccagagaaucgagaccuggauccugagacaccccggcuucaccaucauggccgccauccuggccuacaccaucggcaccacccacuuccagagagugcugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaaggaggagcaggacaagagauucgugugcaagcacagcaugguggacagaggcuggggcaacggcugcggccuguucggcaagggcggcaucgugaccugcgccauguucaccugcaagaagaacauggagggcaagaucgugcagcccgagaaccuggaguacaccaucguggugaccccccacagcggcgaggagcacgccgugggcaacgacaccggcaagcacggcaaggagaucaaggugaccccccagagcagcaucaccgaggccgagcugaccggcuacggcaccgugaccauggagugcagccccagaaccggccuggacuucaacgagauggugcugcugcagauggagaacaaggccuggcuggugcacagacagugguuccuggaccugccccugcccuggcugcccggcgccgacaagcaggagagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucgugaucagagugcaguacgagggcgacggcagccccugcaagauccccuucgagaucauggaccuggagaagagauacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcaucgugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccaggaggagggcaucugcggcaucagaagcgugaccagacuggagaaccugauguggaagcagaucacccccgagcugaaccacauccuggccgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagcuacaaccagaccuuccugaucgacggccccgagaccgccgagugccccaacaccaacagagccuggaacagccuggagguggaggacuacggcuucggcguguucaccaccaacaucuggcugaagcugaaggagaagcaggacgccuucugcgacagcaagcugaugagcgccgccaucaaggacaacagagccgugcacgccgacaugggcuacuggaucgagagcgcccugaacgacaccuggaagaucgagaaggccagcuucaucgaggugaagaacugccacuggcccaagagccacacccuguggagcaacggcgugcuggagagcgagaugaucauccccaagaaccuggccggccccgugagccagcacaacuacagacugggcuaccacacccagaucgccggccccuggcaccugggcaagcuggagauggacuucgacuucugcgacggcaccaccgugaucgugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagguggacaacuucagccugggcgugcugggcauggcccuguuccuggaggagaugcugagaaccagagugggcaccaagcacgccauccugcugguggccgugagcuucgugacccugaucaccggcaacaugagcuucaaggaccugggcagagugguggugauggugggcgccaccauggccgacgacaucggcaugggcgugaccuaccuggcccugcuggccgccuucaaggugagacccaccuucgccgccggccugcugcugagaaagcugaccagcaaggagcugaugaugaccaccaucggcaucgugcugcugagccagagcaccauccccgagaccgugcuggagcugaccgacgcccuggcccugggcaugauggugcugaagaucgugagaaacauggagaaguaccagcuggccgugaccaucauggccauccugugcgugcccaacgccgugauccugcagaacgccuggaaggugagcugcaccauccuggccguggugagcgugagcccccugcugcugaccagcagccagcagaagaccgacuggaucccccuggcccugaccaucaagggccugaaccccaccgccaucuuccugaccacccugagcagaaccaacaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccaccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggccuguuccccaucagcauccccaucaccgccgccgccugguaccugugggaggugaagaagcagagagccggcgugcugugggacgugcccagccccccccccaugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacaagggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucaucgacaagaagggcaagguggugggccuguacggcaacggcguggugaccagaagcggcgccuacgugagcgccaucgcccagaccgagaagggcaucgaggacaaccccgagaucgaggacgacaucuucagaaagagaagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucaucgacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaagauggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaagaccagagacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcagaggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggacuucggccugggcagcaucgccacccagcagcccgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggaccccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaucccccccgagaagugcgacacccugcugugcgacaucggcgagagcagccccaaccccaccguggaggccggcagaacccugagagugcugaaccugguggagaacuggcugaacaacaacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccagcggcaacaucgugagcagcgugaacaugaucagcagaaugcugaucaacagauucaccaugagacacaagaaggccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacgugcugcccaccgugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcagauucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacauggagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcguguucaagaacauccagcaccugaccgugaccgaggagguggccgugcagaacuggcuggccagagugggcagagagagacugagcagaauggccaucagcggcgacgacugcguggugaagccccuggacgacagauucgccaacgcccugaccgcccugaacgacaugggcaagaucagaaaggacauccagcagugggagcccagcaagggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugagagagaccgccugccugggcaagagcuacgcccagauguggagccugauguacuuccacagaagagaccugagacuggccgccaacgccaucugcagcgccgugcccagccacugggugcccaccagcagaaccaccuggagcauccacgccaagcacgaguggaugaccaccgaggacaugcugaccguguggaacagaguguggaucagagagaaccccuggauggaggacaagacccccguggagagcugggaggagauccccuaccugggcaagagagaggaccaguggugcggcagccugaucggccugaccagcagagccaccugggccaagaacauccaggccgccaucaaccaggugagaagccugaucggcaacgaggaguacaccgacuacaugcccagcaugaagagauucagaagagaggaggaggaggccggcgugcugugguga

SEQ ID NO: 17426 - RNA, 9876 nt, Artificial Sequence
  derived and/or modified CDS sequence (opt4) from DENV-2__FJ373299__SS-prME
agcgccggcaugaucaucaugcugauccccaccgugauggccuuccaccugaccaccagaaacggcgagccccacaugaucgugggcauccaggagaagggcaagagccugcuguucaagaccgaggacggcgugaacaugugcacccugauggccauggaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgcccagagaaucgagaccuggauccugagacaccccggcuucaccaucauggccgccauccuggccuacaccaucggcaccacccacuuccagagagugcugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaaggaggagcaggacaagagauucgugugcaagcacagcaugguggacagaggcuggggcaacggcugcggccuguucggcaagggcggcaucgugaccugcgccauguucaccugcaagaagaacauggagggcaagaucgugcagcccgagaaccuggaguacaccaucguggugaccccccacagcggcgaggagcacgccgugggcaacgacaccggcaagcacggccaggagaucaaggugaccccccagagcagcaucaccgaggccgagcugaccggcuacggcaccgugaccauggagugcagccccagaaccggccuggacuucaacgagauggugcugcugcagauggagaacaaggccuggcuggugcacagacagugguuccuggaccugccccugcccuggcugcccggcgccgacaagcaggagagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucgugaucagagugcaguacgagggcgacggcagccccugcaagauccccuucgagaucauggaccuggagaagagauacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcaucgugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccaggaggagggcaucugcggcaucagaagcgugaccagacuggagaaccugauguggaagcagaucacccccgagcugaaccacauccuggccgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagcuacaaccagaccuuccugaucgacggccccgagaccgccgagugccccaacaccaacagagccuggaacagccuggagguggaggacuacggcuucggcguguucaccaccaacaucuggcugaagcugaaggagaagcaggacgccuucugcgacagcagacugaugagcgccgccaucaaggacaacagagccgugcacgccgacaugggcuacuggaucgagagcgcccugaacgacaccuggaagaucgagaaggccagcuucaucgaggugaagaacugccacuggcccaagagccacacccuguggagcaacggcgugcuggagagcgagaugaucauccccaagaaccuggccggccccgugagccagcacaacuacagacccggcuaccacacccagaucgccggccccuggcaccugggcaagcuggagauggacuucgacuucugcgacggcaccaccgugaucgugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagguggacaacuucagccugggcgugcugggcauggcccuguuccuggaggagaugcugagaaccagagugggcaccaagcacgccauccugcugguggccgugagcuucgugacccugaucaccggcaacaugagcuucaaggaccugggcagagugguggugauggugggcgccaccauggccgacgacaucggcaugggcgugaccuaccuggcccugcuggccgccuucaaggugagacccaccuucgccgccggccugcugcugagaaagcugaccagcaaggagcugaugaugaccaccaucggcaucgugcugcugagccagagcaccauccccgagaccgugcuggagcugaccgacgcccuggcccugggcaugauggugcugaagaucgugagaaacauggagaaguaccagcuggccgugaccaucauggccauccugugcgugcccaacgccgugauccugcagaacgccuggaaggugagcugcaccauccuggccguggugagcgugagcccccugcugcugaccagcagccagcagaagaccgacuggaucccccuggcccugaccaucaagggccugaaccccaccgccaucuuccugaccacccugagcagaaccaacaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccaccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggccuguuccccaucagcauccccaucaccgccgccgccugguaccugugggaggugaagaagcagagagccggcgugcugugggacgugcccagccccccccccaugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacaagggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucaucgacaagaagggcaagguggugggccuguacggcaacggcguggugaccagaagcggcgccuacgugagcgccaucgcccagaccgagaagagcaucgaggacaaccccgagaucgaggacgacaucuucagaaagagaagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucaucgacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccggcggcaucaacuacgccgacagaagauggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaagaccagagacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcagaggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucgccacccagcagcccgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggaccccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaugggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaucccccccgagaagugcgacacccugcugugcgacaucggcgagagcagccccaaccccaccguggaggccggcagaacccugagagugcugaaccugguggagaacuggcugaacaacaacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccagcggcaacaucgugagcagcgugaacaugaucagcagaaugcugaucaacagauucaccaugagacacaagaaggccaccuacgagcccgacguggaccugggcagcggcaccagaaacaucggcaucgagagcgagacccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacgugcugcccaccgugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcagauucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacauggagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcguguucaagaacauccagcaccugaccgugaccgaggagguggccgugcagaacuggcuggccagagugggcagagagagacugagcagaauggccaucagcggcgacgacugcguggugaagccccuggacgacagauucgccaacgcccugaccgcccugaacgacaugggcaagaucagaaaggacauccagcagugggagcccagcaagggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugagagagaccgccugccugggcaagagcuacgcccagauguggagccugauguacuuccacagaagagaccugagacuggccgccaacgccaucugcagcgccgugcccagccacugggugcccaccagcagaaccaccuggagcauccacgccaagcacgaguggaugaccaccgaggacaugcugaccguguggaacagaguguggaucagagagaaccccuggauggaggacaagacccccguggagagcugggaggagauccccuaccugggcaagagagaggaccaguggugcggcagccugaucggccugaccagcagagccaccugggccaagaacauccagguggccaucaaccaggugagaagccugaucggcaacgaggaguacaccgacuacaugcccagcaugaagagauucagaagagaggaggaggaggccggcgugcugugguga

SEQ ID NO: 17427 - RNA, 9876 nt, Artificial Sequence
  derived and/or modified CDS sequence (opt4) from DENV-2__FJ410193__SS-prME
agcgccggcaugaucaucaugcugauccccaccgugauggccuuccaccugaccaccagaaacggcgagccccacaugaucgugggcauccaggagaagggcaagagccugcuguucaagaccgaggacggcgugaacaugugcacccugauggccauggaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgcccagagaaucgagaccuggauccugagacaccccggcuucaccaucauggccgccauccuggccuacaccaucggcaccacccacuuccagagagugcugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaaggaggagcaggacaagagauucaucugcaagcacagcaugguggacagaggcuggggcaacggcugcggccuguucggcaagggcggcaucgugaccugcgccauguucaccugcaagaagaacauggagggcaagaucgugcagcccgagaaccuggaguacaccaucguggugaccccccacagcggcgaggagcacgccgugggcaacgacaccggcaagcacggcaaggagaucaaggugaccccccagagcagcaucaccgaggccgagcugaccggcuacggcaccgugaccauggagugcagccccagaaccggccuggacuucaacgagauggugcugcugcagauggagaacaaggccuggcuggugcacagacagugguuccuggaccugccccugcccuggcugcccggcgccgacaagcaggagagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucgugaucagagugcaguacgagggcgacggcagccccugcaagauccccuucgagaucauggaccuggagaagagauacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcaucgugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccaggaggagggcaucugcggcaucagaagcgugaccagacuggagaaccugauguggaagcagaucacccccgagcugaaccacauccuggccgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagcuacaaccagaccuuccugaucgacggccccgagaccgccgagugccccaacaccaacagagccuggaacagccuggagguggaggacuacggcuucggcguguucaccaccaacaucuggcugaagcugaaggagaagcaggacgccuucugcgacagcaagcugaugagcgccgccaucaaggacaacagagccgugcacgccgacaugggcuacuggaucgagagcgcccugaacgacaccuggaagaucgagaaggccagcuucaucgaggugaagaacugccacuggcccaagagccacacccuguggagcaacggcgugcuggagagcgagaugaucauccccaagaaccuggccggccccgugagccagcacaacuacagacccggcuaccacacccagaucgccggccccuggcaccugggcaagcuggagauggacuucgacuucugcgacggcaccaccgugaucgugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagguggacaacuucagccugggcgugcugggcauggcccuguuccuggaggagaugcugagaaccagagugggcaccaagcacgccauccugcugguggccgugagcuucgugacccugaucaccggcaacaugagcuucaaggaccugggcagagugguggugauggugggcgccaccauggccgacgacaucggcaugggcgugaccuaccuggcccugcuggccgccuucaaggugagacccaccuucgccgccggccugcugcugagaaagcugaccagcaaggagcugaugaugaccaccaucggcaucgugcugcugagccagagcaccauccccgagaccgugcuggagcugaccgacgcccuggcccugggcaugauggugcugaagaucgugagaaacauggagaaguaccagcuggccgugaccaucauggccauccugugcgugcccaacgccgugauccugcagaacgccuggaaggugagcugcaccauccuggccguggugagcgugagcccccugcugcugaccagcagccagcagaagaccgacuggaucccccuggcccugaccaucaagggccugaaccccaccgccaucuuccugaccacccugagcagaaccaacaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccaccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggccuguuccccaucagcauccccaucaccgccgccgccugguaccugugggaggugaagaagcagagagccggcgugcugugggacgugcccagccccccccccaugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacaagggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucaucgacaagaagggcaagguggugggccuguacggcaacggcguggugaccagaagcggcgccuacgugagcgccaucgcccagaccgagaagagcaucgaggacaaccccgagaucgaggacgacaucuucagaaagagaagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucaucgacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaagauggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaagaccagagacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcagaggcaucggcaagaugacccugggcaugugcugcaucaccaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucgccacccagcagcccgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggaccccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaugggcgagacccugggcgagaaguggaagagcagacugaacgcccugggcaagagcgaguuccagaucuacaagagaagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaucccccccgagaagugcgacacccugcugugcgacaucggcgagagcagccccaaccccaccguggaggccggcagaacccugagagugcugaaccugguggagaacuggcugaacaacaacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccagcggcaacaucgugagcagcgugaacaugaucagcagaaugcugaucaacagauucaccaugagacacaagaaggccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacgugcugcccaccgugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcagauucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacauggagggcgagcacaagaagcuggccgaggccaucuucaagcugaccuaccagaacaagguggugagagugcagagacccgcccccagaggcaccgugauggacaucaucagcagaagagaccagagaggcagcggccaggugggcaccuacggccugaacaccuucaccaacauggaggcccagcugaucagacagauggagggcgagggcguguucaagaacauccagcaccugaccgugaccgaggagguggccgugcagaacuggcuggccagagugggcagagagagacugagcagaauggccaucagcggcgacgacugcguggugaagccccuggacgacagauucgccaacgcccugaccgcccugaacgacaugggcaagaucagaaaggacauccagcagugggagcccagcaagggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugagagagaccgccugccugggcaagagcuacgcccagauguggagccugauguacuuccacagaagagaccugagacuggccgccaacgccaucugcagcgccgugcccagccacugggugcccaccagcagaaccaccuggagcauccacgccaagcacgaguggaugaccaccgaggacaugcugaccguguggaacagaguguggaucagagagaaccccuggauggaggacaagacccccguggagagcugggaggagauccccuaccugggcaagagagaggaccaguggugcggcagccugaucggccugaccagcagagccaccugggccaagaacauccaggccgccaucaaccaggugagaagccugaucggcaacgaggaguacaccgacuacaugcccagcaugaagagauucagaagagaggaggaggaggccggcgugcugugguga

SEQ ID NO: 17428 - RNA, 9876 nt, Artificial Sequence
  derived and/or modified CDS sequence (opt4) from DENV-2__FJ410195__SS-prME
agcgccggcaugaucaucaugcugauccccaccgugauggccuuccaccugaccaccagaaacggcgagccccacaugaucgugggcauccaggagaagggcaagagccugcuguucaagaccgaggacggcgugaacaugugcacccugauggccauggaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgcccagagaaucgagaccuggauccugagacaccccggcuucaccaucauggccgccauccuggccuacaccaucggcaccacccacuuccagagagugcugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaaggaggagcaggacaagagauucgugugcaagcacagcaugguggacagaggcuggggcaacggcugcggccuguucggcaagggcggcaucgugaccugcgccauguucaccugcaagaagaacauggagggcaagaucgugcagcccgagaaccuggaguacaccaucguggugaccccccacagcggcgaggagcacgccgugggcaacgacaccggcaagcacggcaaggagaucaaggugaccccccagagcagcaucaccgaggccgagcugaccggcuacggcaccgugaccauggagugcagccccagaaccggccuggacuucaacgagauggugcugcugcagauggagaacaaggccuggcuggugcacagacagugguuccuggaccugccccugcccuggcugcccggcgccgacaagcaggagagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucgugaucagagugcaguacgagggcgacggcagccccugcaagauccccuucgagaucauggaccuggagaagagauacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcaucgugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccaggaggagggcaucugcggcaucagaagcgugaccagacuggagaaccugauguggaagcagaucacccccgagcugaaccacauccuggccgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagcuacaaccagaccuuccugaucgacggccccgagaccgccgagugccccaacaccaacagagccuggaacagccuggagguggaggacuacggcuucggcguguucaccaccaacaucuggcugaagcugaaggagaagcaggacgccuucugcgacagcaagcugaugagcgccgccaucaaggacaacagagccgugcacgccgacaugggcuacuggaucgagagcgcccugaacgacaccuggaagaucgagaaggccagcuucaucgaggugaagaacugccacuggcccaagagccacacccuguggagcaacggcgugcuggagagcgagaugaucauccccaagaaccuggccggccccgugagccagcacaacuacagacccggcuaccacacccagaucgccggccccuggcaccugggcaagcuggagauggacuucgacuucugcgacggcaccaccgugaucgugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagguggacaacuucagccugggcgugcugggcauggcccuguuccuggaggagaugcugagaaccagagugggcaccaagcacgccauccugcugguggccgugagcuucgugacccugaucaccggcaacaugagcuucaaggaccugggcagagugguggugaucgugggcgccaccauggccgacgacaucggcaugggcgugaccuaccuggcccugcuggccgccuucaaggugagacccaccuucgccgccggccugcugcugagaaagcugaccagcaaggagcugaugaugaccaccaucggcaucgugcugcugagccagagcaccauccccgagaccgugcuggagcugaccgacgcccuggcccugggcaugauggugcugaagaucgugagaaacauggagaaguaccagcuggccgugaccaucaugaccauccugugcgugcccaacgccgugauccugcagaacgccuggaaggugagcugcaccauccuggccguggugagcgugagcccccugcugcugaccagcagcagacagaagaccgacuggaucccccuggcccugaccaucaagggccugaaccccaccgccaucuuccugaccacccugagcagaaccaacaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccaccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggccugcugcccaucagcauccccaucaccgccgccgccugguaccugugggaggugaagaagcagagagccggcgugcugugggacgugcccagccccccccccaugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacaagggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucaucgacaagaagggcaagguggugggccuguacggcaacggcguggugaccagaagcggcgccuacgugagcgccaucgcccagaccgagaagagcaucgaggacaaccccgagaucgaggacgacaucuucagaaagagaagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucaucgacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaagauggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaagaccagagacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcagaggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucgccacccagcagcccgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggaccccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaugggcgagacccugggcgagaaguggaagagcagacugaacgcccugggcaagaacgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaucccccccgagaagugcgacacccugcugugcgacaucggcgagagcagccccaaccccaccguggaggccggcagaacccugagagugcugaaccugguggagaacuggcugaacaacaacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccagcggcaacaucgugagcagcgugaacaugaucagcagaaugcugaucaacagauucaccaugagacacaagaaggccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacgugcugcccaccgugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcagauucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacauggagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcguguucaagaacauccagcaccugaccgugaccgaggagguggccgugcagaacuggcuggccagagugggcagagagagacugagcagaauggccaucagcggcgacgacugcguggugaagccccuggacgacagauucgccaacgcccugaccgcccugaacgacaugggcaagaucagaaaggacauccagcagugggagcccagcaagggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugagagagaccgccugccugggcaagagcuacgcccagauguggagccugauguacuuccacagaagagaccugagacuggccgccaacgccaucugcagcgccgugcccagccacugggugcccaccagcagaaccaccuggagcauccacgccaagcacgaguggaugaccaccgaggacaugcugaccguguggaacagaguguggaucagagagaaccccuggauggaggacaagacccccguggagagcugggaggagauccccuaccugggcaagagagaggaccaguggugcggcagccugaucggccugaccagcagagccaccugggccaagaacauccaggccgccaucaaccaggugagaagccugaucggcaacgaggaguacaccgacuacaugcccagcaugaagagauucagaagagaggaggaggaggccggcgugcugugguga

SEQ ID NO: 17429 - RNA, 9876 nt, Artificial Sequence
  derived and/or modified CDS sequence (opt4) from DENV-2__FJ432726__SS-prME
agcgccggcaugaucaucaugcugauccccaccgugauggccuuccaccugaccaccagaaacggcgagccccacaugaucgugggcauccaggagaagggcaagagccugcuguucaagaccgaggacggcgugaacaugugcacccugauggccauggaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgcccagagaaucgagaccuggauccugagacaccccggcuucaccaucauggccgccauccuggccuacaccaucggcaccacccacuuccagagagugcugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaaggaggagcaggacaagagauucgugugcaagcacagcaugguggacagaggcuggggcaacggcugcggccuguucggcaagggcggcaucgugaccugcgccauguucaccugcaagaagaacauggagggcaagaucgugcagcccgagaaccuggaguacaccaucguggugaccccccacagcggcgaggagcacgccgugggcaacgacaccggcaagcacggcauggagaucaaggugaccccccagagcagcaucaccgaggccgagcugaccggcuacggcaccgugaccauggagugcagccccagaaccggccuggacuucaacgagauggugcugcugcagauggagaacaaggccuggcuggugcacagacagugguuccuggaccugccccugcccuggcugcccggcgccgacaagcaggagagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucgugaucagagugcaguacgagggcgacggcagccccugcaagauccccuucgagaucauggaccuggagaagagauacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcaucgugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccaggaggagggcaucugcggcaucagaagcgugaccagacuggagaaccugauguggaagcagaucacccccgagcugaaccacauccuggccgagaacgaggugaagcugaccaucaugaccggcgacaucagaggcaucaugcaggccggcaagagaagccugagaccccagcccaccgagcugaaguacagcuggaagaccuggggcaaggccaagaugcugagcaccgagagcuacaaccagaccuuccugaucgacggccccgagaccgccgagugccccaacaccaacagagccuggaacagccuggagguggaggacuacggcuucggcguguucaccaccaacaucuggcugaagcugaaggagaagcaggacgccuucugcgacagcaagcugaugagcgccgccaucaaggacaacagagccgugcacgccgacaugggcuacuggaucgagagcgcccugaacgacaccuggaagaucgagaaggccagcuucaucgaggugaagaacugccacuggcccaagagccacacccuguggagcaacggcgugcuggagagcgagaugaucauccccaagaaccuggccggccccgccagccagcacaacuacagacccggcuaccacacccagaucgccggccccuggcaccugggcaagcuggagauggacuucgacuucugcgacggcaccaccgugaucgugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagguggacaacuucagccugggcgugcugggcauggcccuguuccuggaggagaugcugagaaccagagugggcaccaagcacgccauccugcugguggccgugagcuucgugacccugaucaccggcaacaugagcuucaaggaccugggcagagugguggugauggugggcgccaccauggccgacgacaucggcaugggcgugaccuaccuggcccugcuggccgccuucaaggugagacccaccuucgccgccggccugcugcugagaaagcugaccagcaaggagcugaugaugaccaccaucggcaucgugcugcugagccagagcaccauccccgagaccgugcuggagcugaccgacgcccuggcccugggcaugauggugcugaagaucgugagaaacauggagaaguaccagcuggccgugaccaucauggccauccugugcgugcccaacgccgugauccugcagaacgccuggaaggugagcugcaccauccuggccguggugagcgugagcccccugcugcugaccagcagccagcagaagaccgacuggaucccccuggcccugaccaucaagggccugaaccccaccgccaucuuccugaccacccugagcagaaccaacaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccaccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggccuguuccccaucagcauccccaucaccgccgccgccugguaccugugggaggugaagaagcagagagccggcgugcugugggacgugcccagccccccccccaugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacaagggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucaucgacaagaagggcaagguggugggccuguacggcaacggcguggugaccagaagcggcgccuacgugagcgccaucgcccagaccgagaagagcaucgaggacaaccccgagaucgaggacgacaucuucagaaagagaagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucaucgacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaagauggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaagaccagagacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcagaggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucgccacccagcagcccgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggaccccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaucccccccgagaagugcgacacccugcugugcgacaucggcgagagcagccccaaccccaccguggaggccggcagaacccugagagugcugaaccugguggagaacuggcugaacaacaacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccagcggcaacaucgugagcagcgugaacaugaucagcagaaugcugaucaacagauucaccaugagacacaagaaggccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacgugcugcccaccgugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcagauucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacauggagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcguguucaagaacauccagcaccugaccgugaccgaggagguggccgugcacaacuggcuggccagagugggcagagagagacugagcagaauggccaucagcggcgacgacugcguggugaagccccuggacgacagauucgccaacgcccugaccgcccugaacgacaugggcaagaucagaaaggacauccagcagugggagcccagcaagggcuggaacgacuggacccaggugcccuucugcagccaccacuuccacgagcugaucaugaaggacggcagaauccugguggugcccugcagaaaccaggacgagcugaucggcagagccagaaucagccagggcgccggcuggagccugagagagaccgccugccugggcaagagcuacgcccagauguggagccugauguacuuccacagaagagaccugagacuggccgccaacgccaucugcagcgccgugcccagccacugggugcccaccagcagaaccaccuggagcauccacgccaagcacgaguggaugaccaccgaggacaugcugaccguguggaacagaguguggaucagagagaaccccuggauggaggacaagacccccguggagagcugggaggagauccccuaccugggcaagagagaggaccaguggugcggcagccugaucggccugaccagcagagccaccugggccaagaacauccaggccgccaucaaccaggugagaagccugaucggcaacgaggaguacaccgacuacaugcccagcaugaagagauucagaagagaggaggaggaggccggcgugcugugguga

SEQ ID NO: 17430 - RNA, 9876 nt, Artificial Sequence
  derived and/or modified CDS sequence (opt4) from DENV-2__JF730049__SS-prME
agcgccggcaugaucaucaugcugauccccaccgugauggccuuccaccugaccaccagaaacggcgagccccacaugaucgugggcauccaggagaagggcaagagccugcuguucaagaccgaggacggcgugaacaugugcacccugauggccauggaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgcccagagaaucgagaccuggauccugagacaccccggcuucaccaucauggccgccauccuggccuacaccaucggcaccacccacuuccagagagugcugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaaggaggagcaggacaagagauucgugugcaagcacagcaugguggacagaggcuggggcaacggcugcggccuguucggcaagggcggcaucgugaccugcgccauguucaccugcaagaagaacauggagggcaagaucgugcagcccgagaaccuggaguacaccaucguggugaccccccacagcggcgaggagcacguggugggcaacgacaccggcaagcacggccaggagaucaaggugaccccccagagcagcaucaccgaggccgagcugaccggcuacggcaccgugaccauggagugcagccccagaaccggccuggacuucaacgagauggugcugcugcagauggagaacaaggccuggcuggugcacagacagugguuccuggaccugccccugcccuggcugcccggcgccgacaagcaggagagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucgugaucagagugcaguacgagggcgacggcagccccugcaagauccccuucgagaucauggaccuggagaagagauacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcaucgugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccaggaggagggcaucugcggcaucagaagcgugaccagacuggagaaccugauguggaagcagaucacccccgagcugaaccacauccugaccgagaacgaggugaagcugaccaucaugaccggcgacaucaagggcaucaugcaggccggcaagagaagccugagaccccagcccaccgagcugaaguacagcuggaagaccuggggcaaggccaagauguucagcaccgagagcuacaaccagaccuuccugaucgacggccccgagaccgccgagugccccaacaccaacagagccuggaacagccuggagguggaggacuacggcuucggcguguucaccaccaacaucuggcugaagcugaaggagaagcaggacgccuucugcgacagcaagcugaugagcgccgccaucaaggacaacagagccgugcacgccgacaugggcuacuggaucgagagcgcccugaacgacaccuggaagaucgagaaggccagcuucaucgaggugaagaacugccacuggcccaagagccacacccuguggagcaacggcgugcuggagagcgagaugaucauccccaagaaccuggccggccccgugagccagcacaacuacagacccggcuaccacacccagaucgccggccccuggcaccugggcaagcuggagauggacuucgacuucugcgacggcaccaccgugaucgugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagguggacaacuucagccugggcgugcugggcauggcccuguuccuggaggagaugcugaagaccagagugggcaccaagcacgccauccugcugguggccgugagcuucgugacccugaucaccggcaacaugagcuucaaggaccugggcagagugguggugauggugggcgccaccauggccgacgacaucggcaugggcgugaccuaccuggcccugcuggccgccuucaaggugagacccaccuucgccgccggccugcugcugagaaagcugaccagcaaggagcugaugaugaccaccaucggcaucgugcugcugagccagagcaccauccccgagaccgugcuggagcugaccgacgcccuggcccugggcaugauggugcugagaaucgugagaaacauggagaaguaccagcuggccgugaccaucauggccauccugugcgugcccaacgccgugauccugcagaacgccuggaaggugagcugcaccauccuggccguggugagcgugagcccccugcugcugaccagcagccagcagaagaccgacuggaucccccuggcccugaccaucaagggccugaaccccaccgccaucuuccugaccacccugagcagaaccaacaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccaccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggccuguuccccaucagcauccccaucaccgccgccgccugguaccugugggaggugaagaagcagagagccggcgugcugugggacgugcccagccccccccccaugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacaagggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccagcaccggcaccaucggcgccgugagccuggacuucagccccggcaccagcggcagccccaucaucgacaagaagggcaagguggugggccuguacggcaacggcguggugaccagaagcggcgccuacgugagcgccaucgcccagaccgagaagagcaucgaggacaaccccgagaucgaggacgacaucuucagaaagagaagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucaucgacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaagauggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaagaccagagacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcagaggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucgccacccagcagcccgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggaccccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaugggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaucccccccgagaagugcgacacccugcugugcgacaucggcgagagcagccccaaccccaccguggaggccggcagaacccugagagugcugaaccugguggagaacuggcugaacaacaacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccagcggcaacaucgugagcagcgugaacaugaucagcagaaugcugaucaacagauucaccaugagacacaagaaggccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacgugcugcccaccgugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcagauucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacauggagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcguguucaagaacauccagcaccugaccgugaccgaggagguggccgugcagaacuggcuggccagagugggcagagagagacugagcagaauggccaucagcggcgacgacugcguggugaagccccuggacgacagauucgccaacgcccugaccgcccugaacgacaugggcaagaucagaaaggacauccagcagugggagcccagcaagggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugagagagaccgccugccugggcaagagcuacgcccagauguggagccugauguacuuccacagaagagaccugagacuggccgccaacgccaucugcagcgccgugcccagccacugggugcccaccagcagaaccaccuggagcauccacgccaagcacgaguggaugaccaccgaggacaugcugaccguguggaacagaguguggaucagagagaaccccuggauggaggacaagacccccguggagagcugggaggagauccccuaccugggcaagagagaggaccaguggugcggcagccugaucggccugaccagcagagccaccugggccaagaacauccaggccgccaucaaccaggugagaagccugaucggcaucgaggaguacaccgacuacaugcccagcaugaagagauucagaagagaggaggaggaggccggcgugcugugguga

SEQ ID NO: 17431 - RNA, 9876 nt, Artificial Sequence
  derived and/or modified CDS sequence (opt4) from DENV-2__FJ562098__SS-prME
agcgccggcaugaucaucaugcugauccccaccgugauggccuuccaccugaccaccagaaacggcgagccccacaugaucgugggcauccaggagaagggcaagagccugcuguucaagaccgaggacggcgugaacaugugcacccugauggccauggaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgcccagagaaucgagaccuggauccugagacaccccggcuucaccaucauggccgccauccuggccuacaccaucggcaccacccacuuccagagagugcugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaaggaggagcaggacaagagauucgugugcaagcacagcaugguggacagaggcuggggcaacggcugcggccuguucggcaagggcggcaucgugaccugcgccauguucaccugcaagaagaacauggagggcaagaucgugcagcccgagaaccuggaguacaccaucguggugaccccccacagcggcgaggagcacgccgugggcaacgacaccggcaagcacggcaaggagaucaaggugaccccccagagcagcaucaccgaggccgagcugaccggcuacggcaccgugaccauggagugcagccccagaaccggccuggacuucaacgagauggugcugcugcagauggagaacaaggccuggcuggugcacagacagugguuccuggaccugccccugcccuggcugcccggcgccgacaagcaggagagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucgugaucagagugcaguacgagggcgacggcagccccugcaagauccccuucgagaucauggaccuggagaagagauacgugcugggcagacugaucaccgugaaccccaucgccaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcaucgugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccaggaggagggcaucugcggcaucagaagcgugaccagacuggagaaccugauguggaagcagaucacccccgagcugaaccacauccuggccgagaacgaggugaagcugaccaucaugaccggcgacaucaagggcaucaugcaggccggcaagagaagccugagaccccagcccaucgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucaccaccaacaucuggcugagacugaaggagaagcaggacgccuucugcgacagcaagcugaugagcgccgccaucaaggacaacagagccgugcacgccgacaugggcuacuggaucgagagcgcccugaacgacaccuggaagaucgagaaggccagcuucaucgaggugaagaacugccacuggcccaagagccacacccuguggagcaacggcgugcuggagagcgagauggugauccccaagaaccuggccggccccgugagccagcacaacuacagacccggcuaccacacccagaucgccggccccuggcaccugggcaagcuggagauggacuucgacuucugcgacggcaccaccgugaucgugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagguggacaacuucagccugggcgugcugggcauggcccuguuccuggaggagaugcugagaaccagagugggcaccaagcacgccauccugcugguggccgugagcuucgugacccugaucaccggcaacaugagcuucaaggaccugggcagagugguggugauggugggcgccaccauggccgacgacaucggcaugggcgugaccuaccuggcccugcuggccgccuucaaggugagacccaccuucgccgccggccugcugcugagaaagcugaccagcaaggagcugaugaugaccaccaucggcaucgugcugcugagccagagcaccauccccgagaccgugcuggagcugaccgacgcccuggcccugggcaugauggugcugaagaucgugagaaacauggagaaguaccagcuggccgugaccaucauggccauccugugcgugcccaacgccgugauccugcagaacgccuggaaggugagcugcaccauccuggccguggugagcgugagcccccugcugcugaccagcagccagcagaagaccgacuggaucccccuggcccugaccaucaagggccugaaccccaccgccaucuuccugaccacccugagcagaaccaacaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccaccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggccuguuccccaucagcauccccaucaccgccgccgccugguaccugugggaggugaagaagcagagagccggcgugcugugggacgugcccagccccccccccaugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacaagggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucaucgacaagaagggcaagguggugggccuguacggcaacggcguggugaccagaagcggcgccuacgugagcgccaucgcccagaccgagaagagcaucgaggacaaccccgagaucgaggacgacaucuucagaaagagaagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucaucgacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaagauggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaagaccagagacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcagaggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucgccacccagcagcccgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggaccccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaugggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaucccccccgagaagugcgacacccugcugugcgacaucggcgagagcagccccaaccccaccguggaggccggcagaacccugagagugcugaaccugguggagaacuggcugaacaacaacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccagcggcaacaucgugagcagcgugaacaugaucagcagaaugcugaucaacagauucaccaugagacacaagaaggccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacgugcugcccaccgugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcagauucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacauggagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcguguucaagaacauccagcaccugaccgugaccgaggagguggccgugcagaacuggcuggccagagugggcagagagagacugagcagaauggccaucagcggcgacgacugcguggugaagccccuggacgacagauucgccaacgcccugaccgcccugaacgacaugggcaagaucagaaaggacauccagcagugggagcccagcaagggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugagagagaccgccugccugggcaagagcuacgcccagauguggagccugauguacuuccacagaagagaccugagacuggccgccaacgccaucugcagcgccgugcccagccacugggugcccaccagcagaaccaccuggagcauccacgccaagcacgaguggaugaccaccgaggacaugcugaccguguggaacagaguguggaucagagagaaccccuggauggaggacaagacccccguggagagcugggaggagauccccuaccugggcaagagagaggaccaguggugcggcagccugaucggccugaccagcagagccaccugggccaagaacauccaggccgccaucaaccaggugagaagccugaucggcaacgaggaguacaccgacuacaugcccagcaugaagagauucagaagagaggaggaggaggccggcgugcugugguga

SEQ ID NO: 17432 - RNA, 9876 nt, Artificial Sequence
  derived and/or modified CDS sequence (opt4) from DENV-2__FJ859028__SS-prME
agcgccggcaugaucaucaugcugauccccaccgugauggccuuccaccugaccaccagaaacggcgagccccacaugaucgugggcauccaggagaagggcaagagccugcuguucaagaccgaggacggcgugaacaugugcacccugauggccauggaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgcccagagaaucgagaccuggauccugagacaccccggcuucaccaucauggccgccauccuggccuacaccaucggcaccacccacuuccagagagugcugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaaggaggagcaggacaagagauucgugugcaagcacagcaugguggacagaggcuggggcaacggcugcggccuguucggcaagggcggcaucgugaccugcgccauguucaccugcaagaagaacauggagggcaagaucgugcagcccgagaaccuggaguacaccaucguggugaccccccacagcggcgaggagcacgccgugggcaacgacaccggcaagcacggccaggagaucaaggugaccccccagagcagcaucaccgaggccgagcugaccggcuacggcaccgugaccauggagugcagccccagaaccggccuggacuucaacgagauggugcugcugcagauggagaacaaggccuggcuggugcacagacagugguuccuggaccugccccugcccuggcugcccggcgccgacaagcaggagagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucgugaucagagugcaguacgagggcgacggcagccccugcaagauccccuucgagaucauggaccuggagaagagauacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcaucgugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccaggaggagggcaucugcggcaucagaagcgugaccagacuggagaaccugauguggaagcagaucacccccgagcugaaccacauccuggccgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagcuacaaccagaccuuccugaucgacggccccgagaccgccgagugccccaacaccaacagagccuggaacagccuggagguggaggacuacggcuucggcguguucaccaccaacaucuggcugaagcugaaggagaagcaggacgccuucugcgacagcaagcugaugagcgccgccaucaagaacaacagagccgugcacgccgacaugggcuacuggaucgagagcgcccugaacgacaccuggaagaucgagaaggccagcuucaucgaggugaagaacugccacuggcccaagagccacacccuguggagcaacggcgugcuggagagcgagaugaucauccccaagaaccuggccggccccgugagccagcacaacuacagacccggcuaccacacccagaucgccggccccuggcaccugggcaagcuggagauggacuucgacuucugcgacggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagguggacaacuucagccugggcgugcugggcauggcccuguuccuggaggagaugcugagaaccagagugggcaccaagcacgccauccugcugguggccgugagcuucgugacccugaucaccggcaacaugagcuucaaggaccugggcagagugguggugauggugggcgccaccauggccgacgacaucggcaugggcgugaccuaccuggcccugcuggccgccuucaaggugagacccaccuucgccgccggccugcugcugagaaagcugaccagcaaggagcugaugaugaccaccaucggcaucgugcugcugagccagagcaccauccccgagaccgugcuggagcugaccgacgcccuggcccugggcaugauggugcugaagaucgugagaaacauggagaaguaccagcuggccgugaccaucauggccauccugugcgugcccaacgccgugauccugcagaacgccuggaaggugagcugcaccauccuggccguggugagcgugagcccccugcugcugaccagcagccagcagaagaccgacuggaucccccuggcccugaccaucaagggccugaaccccaccgccaucuuccugaccacccugagcagaaccaacaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccaccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggccuguuccccaucagcauccccaucaccgccgccgccugguaccugugggaggugaagaagcagagagccggcgugcugugggacgugcccagccccccccccaugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacaagggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucaucgacaagaagggcaagguggugggccuguacggcaacggcguggugaccagaagcggcgccuacgugagcgccaucgcccagaccgagaagagcaucgaggacaaccccgagaucgaggacgacaucuucagaaagagaagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucaucgacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaagauggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaagaccagagacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcagaggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucgccacccagcagcccgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggaccccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaugggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaucccccccgagaagugcgacacccugcugugcgacaucggcgagagcagccccaaccccaccguggaggccggcagaacccugagagugcugaaccugguggagaacuggcugaacaacaacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccagcggcaacaucgugagcagcgugaacaugaucagcagaaugcugaucaacagauucaccaugagacacaagaaggccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacgugcugcccaccgugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcagauucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacauggagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcguguucaagaacauccagcaccugaccgugaccgaggagguggccgugcagaacuggcuggccagagugggcagagagagacugagcagaauggccaucagcggcgacgacugcguggugaagccccuggacgacagauucgccaacgcccugaccgcccugaacgacaugggcaagaucagaaaggacauccagcagugggagcccagcaagggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugagagagaccgccugccugggcaagagcuacgcccagauguggagccugauguacuuccacagaagagaccugagacuggccgccaacgccaucugcagcgccgugcccagccacugggugcccaccagcagaaccaccuggagcauccacgccaagcacgaguggaugaccaccgaggacaugcugaccguguggaacagaguguggaucagagagaaccccuggauggaggacaagacccccguggagagcugggaggagauccccuaccugggcaagagagaggaccaguggugcggcagccugaucggccugaccagcagagccaccugggccaagaacauccagguggccaucaaccaggugagaagccugaucggcaacgaggaguacaccgacuacaugcccagcaugaagagauucagaagagaggaggaggaggccggcgugcugugguga

SEQ ID NO: 17433 - RNA, 9876 nt, Artificial Sequence
  derived and/or modified CDS sequence (opt4) from DENV-2__FJ410200__SS-prME
agcgccggcaugaucaucaugcugauccccaccgugauggccuuccaccugaccaccagaaacggcgagccccacaugaucgugggcauccaggagaagggcaagagccugcuguucaagaccgaggacggcgugaacaugugcacccugauggccauggaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgcccagagaaucgagaccuggauccugagacaccccggcuucaccaucauggccgccauccuggccuacaccaucggcaccacccacuuccagagagugcugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaaggaggagcaggacaagagauucgugugcaagcacagcaugguggacagaggcuggggcaacggcugcggccuguucggcaagggcggcaucgugaccugcgccauguucaccugcaagaagaacauggagggcaagaucgugcagcccgagaaccuggaguacaccaucguggugaccccccacagcggcgaggagcacgccgugggcaacgacaccggcaagcacggccaggagaucaaggugaccccccagagcagcaucaccgaggccgagcugaccggcuacggcaccgugaccauggagugcagccccagaaccggccuggacuucaacgagauggugcugcugcagauggagaacaaggccuggcuggugcacagacagugguuccuggaccugccccugcccuggcugcccggcgccgacaagcaggagagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucgugaucagagugcaguacgagggcgacggcagccccugcaagauccccuucgagaucauggaccuggagaagagauacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcaucgugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccaggaggagggcaucugcggcaucagaagcgugaccagacuggagaaccugauguggaagcagaucacccccgagcugaaccacauccuggccgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagcuacaaccagaccuuccugaucgacggccccgagaccgccgagugccccaacaccaacagagccuggaacagccuggagguggaggacuacggcuucggcguguucaccaccaacaucuggcugaagcugaaggagaagcaggacgccuucugcgacagcaagcugaugagcgccgccaucaaggacaacagagccgugcacgccgacaugggcuacuggaucgagagcgcccugaacgacaccuggaagaucgagaaggccagcuucaucgaggugaagaacugccacuggcccaagagccacacccuguggagcaacggcgugcuggagagcgagaugaucauccccaagaaccuggccggccccgugagccagcacaacuacagacccggcuaccacacccagaucgccggccccuggcaccugggcaagcuggagauggacuucaacuucugcgacggcaccaccgugaucgugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagguggacaacuucagccugggcgugcugggcauggcccuguuccuggaggagaugcugagaaccagagugggcaccaagcacgccauccugcugguggccgugagcuucgugacccugaucaccggcaacaugagcuucaaggaccugggcagagugguggugauggugggcgccaccaugaccgacgacaucggcaugggcgugaccuaccuggcccugcuggccgccuucaaggugagacccaccuucgccgccggccugcugcugagaaagcugaccagcaaggagcugaugaugaccaccaucggcaucgugcugcugagccagagcaccauccccgagaccgugcuggagcugaccgacgcccuggcccugggcaugauggugcugaagaucgugagaaacauggagaaguaccagcuggccgugaccaucauggccauccugugcgugcccaacgccgugauccugcagaacgccuggaaggugagcugcaccauccuggccguggugagcgugagcccccugcugcugaccagcagccagcagaagaccgacuggaucccccuggcccugaccaucaagggccugaaccccaccgccaucuuccugaccacccugagcagaaccaacaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccaccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggccuguuccccaucagcauccccaucaccgccgccgccugguaccugugggaggugaagaagcagagagccggcgugcugugggacgugcccagccccccccccaugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacaagggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucaucgacaagaagggcaagguggugggccuguacggcaacggcguggugaccagaagcggcgccuacgugagcgccaucgcccagaccgagaagagcaucgagaacaaccccgagaucgaggacgacaucuucagaaagagaagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucaucgacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaagauggugcuucgacggcaucaagaacaaccagauccuggaggagaacauggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaagaccagagacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcagaggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucgccaccagacagcccgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggaccccauccccuacgaccccaaguucgagaagcagcugggccaggugaugcugcuggugcugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaugggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaucccccccgagaagugcgacacccugcugugcgacaucggcgagagcagccccaaccccaccguggaggccggcagaacccugagagugcugaaccugguggagaacuggcugaacaacaacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccagcggcaacaucgugagcagcgugaacaugaucagcagaaugcugaucaacagauucaccaugagacacaagaaggccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacgugcugcccaccgugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaagaugcaccagagaggaguucaccagaaaggugagaagcaacgccgcccugggcgccaucuucaccgacgagaacaaguggaagagcgccagagaggccguggaggacagcagauucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacauggagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcguguucaagaacauccagcaccugaccgugaccgaggagguggccgugaagaacuggcuggccagagugggcagagagagacugagcagaauggccaucagcggcgacgacugcguggugaagccccuggacgacagauucgccaacgcccugaccgcccugaacgacaugggcaagaucagaaaggacauccagcagugggagcccagcaagggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugagagagaccgccugccugggcaagagcuacgcccagauguggagccugauguacuuccacagaagagaccugagacuggccgccaacgccaucugcagcgccgugcccagccacugggugcccaccagcagaaccaccuggagcauccacgccaagcacgaguggaugaccaccgaggacaugcugaccguguggaacagaguguggaucagagagaaccccuggauggaggacaagacccccguggagagcugggaggagauccccuaccugggcaagagagaggaccaguggugcggcagccugaucggccugaccagcagagccaccugggccaagaacauccaggccgccaucaaccaggugagaagccugaucggcaacgaggaguacaccgacuacaugcccagcaugaagagauucagaagagaggaggaggaggccggcgugcugugguga

SEQ ID NO: 17434 - RNA, 9876 nt, Artificial Sequence
  derived and/or modified CDS sequence (opt4) from DENV-2__FJ410202__SS-prME
agcgccggcaugaucaucaugcugauccccaccgugauggccuuccaccugaccaccagaaacggcgagccccacaugaucgugggcauccaggagaagggcaagagccugcuguucaagaccgaggacggcgugaacaugugcacccugauggccauggaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgcccagagaaucgagaccuggauccugagacaccccggcuucaccaucauggccgccauccuggccuacaccaucggcaccacccacuuccagagagugcugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaaggaggagcaggacaagagauucgugugcaagcacagcaugguggacagaggcuggggcaacggcugcggccuguucggcaagggcggcaucgugaccugcgccauguucaccugcaagaagaacauggagggcaagaucgugcagcccgagaaccuggaguacaccaucguggugaccccccacagcggcgaggagcacgccgugggcaacgacaccggcaagcacggcaaggagaucaaggugaccccccagagcagcaucaccgaggccgagcugaccggcuacggcaccgugaccauggagugcagccccagaaccggccuggacuucaacgagauggugcugcugcagauggagaacaaggccuggcuggugcacagacagugguuccuggaccugccccugcccuggcugcccggcgccgacaagcaggagagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucgugaucagagugcaguacgagggcgacggcagccccugcaagauccccuucgagaucauggaccuggagaagagauacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcgugggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcaucgugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccaggaggagggcaucugcggcaucagaagcgugaccagacuggagaaccugauguggaagcagaucacccccgagcugaaccacauccuggccgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagcuacaaccagaccuuccugaucgacggccccgagaccgccgagugccccaacaccaacagagccuggaacagccuggagguggaggacuacggcuucggcguguucaccaccaacaucuggcugaagcugaaggagaagcaggacgccuucugcgacagcaagcugaugagcgccgccaucaaggacaacagagccgugcacgccgacaugggcuacuggaucgagagcgcccugaacgacaccuggaagaucgagaaggccagcuucaucgaggugaagaacugccacuggcccaagagccacacccuguggagcaacggcgugcuggagagcgagaugaucauccccaagaaccuggccggccccgugagccagcacaacuacagacccggcuaccacacccagaucgccggccccuggcaccugggcaagcuggagauggacuucgacuucugcgacggcaccaccgugaucgugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagguggacaacuucagccugggcgugcugggcauggcccuguuccuggaggagaugcugagaaccagagugggcaccaagcacgccauccugcugguggccgugagcuucgugacccugaucaccggcaacaugagcuucaaggaccugggcagagugguggugauggugggcgccaccauggccgacgacaucggcaugggcgugaccuaccuggcccugcuggccgccuucaaggugagacccaccuucgccgccggccugcugcugagaaagcugaccagcaaggagcugaugaugaccaccaucggcaucgugcugcugagccagagcaccauccccgagaccgugcuggagcugaccgacgcccuggcccugggcaugauggugcugaagaucgugagaaacauggagaaguaccagcuggccgugaccaucauggccauccugugcgugcccaacgccgugauccugcagaacgccuggaaggugagcugcaccauccuggccguggugagcgugagcccccugcugcugaccagcagccagcagaagaccgacuggaucccccuggcccugaccaucaagggccugaaccccaccgccaucuuccugaccacccugagcagaaccaacaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccaccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggccuguuccccaucagcauccccaucaccgccgccgccugguaccugugggaggugaagaagcagagagccggcgugcugugggacgugcccagccccccccccaugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacaagggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucaucgacaagaagggcaagguggugggccuguacggcaacggcguggugaccagaagcggcgccuacgugagcgccaucgcccagaccgagaagagcaucgaggacaaccccgagaucgaggacgacaucuucagaaagagaagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucaucgacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaagauggugcuucgacggcaucaagaacaaccagauccuggaggagaacguggagguggagguguggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaagaccagagacgcccuggacaaccuggccgugcugcacaccgccgaggugggcggcagagccuacaaccacgcccugagcgagcugcccgagacccuggagacccugcugcugcugacccugcuggccaccgugaccggcggcaucuuccuguuccugaugagcggcagaggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucgccacccagcagcccgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggaccccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaugggcgagacccugggcgagaaguggaagagcagacugaacgcccugggcaagagcgaguuccagaucuacaagagaagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaucccccccgagaagugcgacacccugcugugcgacaucggcgagagcagccccaaccccaccguggaggccggcagaacccugagagugcugaaccugguggagaacuggcugaacaacaacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccagcggcaacaucgugagcagcgugaacaugaucagcagaaugcugaucaacagauucaccaugagacacaagaaggccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacgugcugcccaccgugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcagauucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacauggagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcguguucaagaacauccagcaccugaccgugaccgaggagguggccgugcagaacuggcuggccagagugggcagagagagacugagcagaauggccaucagcggcgacgacugcguggugaagccccuggacgacagauucgccaacgcccugaccgcccugaacgacaugggcaagaucagaaaggacauccagcagugggagcccagcaagggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugagagagaccgccugccugggcaagagcuacgcccagauguggagccugauguacuuccacagaagagaccugagacuggccgccaacgccaucugcagcgccgugcccagccacugggugcccaccagcagaaccaccuggagcauccacgccaagcacgaguggaugaccaccgaggacaugcugaccguguggaacagaguguggaucagagagaaccccuggauggaggacaagacccccguggagagcugggaggagauccccuaccugggcaagagagaggaccaguggugcggcagccugaucggccugaccagcagagccaccugggccaagaacauccaggccgccaucaaccaggugagaagccugaucggcaacgaggaguacaucgacuacaugcccagcaugaagagauucagaagagaggaggaggaggccggcgugcugugguga

SEQ ID NO: 17435 - RNA, 9876 nt, Artificial Sequence
  derived and/or modified CDS sequence (opt4) from DENV-2__FJ410208__SS-prME
agcgccggcaugaucaucaugcugauccccaccgugauggccuuccaccugaccaccagaaacggcgagccccacaugaucgugggcauccaggagaagggcaagagccugcuguucaagaccgaggacggcgugaacaugugcacccugauggccauggaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgcccagagaaucgagaccuggauccugagacaccccggcuucaccaucauggccgccauccuggccuacaccaucggcaccacccacuuccagagagugcugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaaggaggagcaggacaagagauucgugugcaagcacagcaugguggacagaggcuggggcaacggcugcggccuguucggcaagggcggcaucgugaccugcgccauguucaccugcaagaagaacauggagggcaagaucgugcagcccgagaaccuggaguacaccaucguggugaccccccacagcggcgaggagcacgccgugggcaacgacaccggcaagcacggccaggagaucaaggugaccccccagagcagcaucaccgaggccgagcugaccggcuacggcaccgugaccauggagugcagccccagaaccggccuggacuucaacgagauggugcugcugcagauggagaacaaggccuggcuggugcacagacagugguuccuggaccugccccugcccuggcugcccggcgccgacaagcaggagagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucgugaucagagugcaguacgagggcgacggcagccccugcaagauccccuucgagaucauggaccuggagaagagauacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcaucgugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccaggaggagggcaucugcggcaucagaagcgugaccagacuggagaaccugauguggaagcagaucacccccgagcugaaccacauccuggccgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagcuacaaccagaccuuccugaucgacggccccgagaccgccgagugccccaacaccaacagagccuggaacagccuggagguggaggacuacggcuucggcguguucaccaccaacaucuggcugaagcugaaggagaagcaggacgccuucugcgacagcaagcugaugagcgccgccaucaaggacaacagagccgugcacgccgacaugggcuacuggaucgagagcgcccugaacgacaccuggaagaucgagaaggccagcuucaucgaggugaagaacugccacuggcccaagagccacacccuguggagcaacggcgugcuggagagcgagaugaucauccccaagaaccuggccggccccgugagccagcacaacuacagacccggcuaccacacccagaucgccggccccuggcaccugggcaagcuggagauggacuucaacuucugcgacggcaccaccgugaucgugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagguggacaacuucagccugggcgugcugggcauggcccuguuccuggaggagaugcugagaaccagagugggcaccaagcacgccauccugcugguggccgugagcuucgugacccugaucaccggcaacaugagcuucaaggaccugggcagagugguggugauggugggcgccaccaugaccgacgacaucggcaugggcgugaccuaccuggcccugcuggccgccuucaaggugagacccaccuucgccgccggccugcugcugagaaagcugaccagcaaggagcugaugaugaccaccaucggcaucgugcugcugagccagagcaccauccccgagaccgugcuggagcugaccgacgcccuggcccugggcaugauggugcugaagaucgugagaaacauggagaaguaccagcuggccgugaccaucauggccauccugugcgugcccaacgccgugauccugcagaacgccuggaaggugagcugcaccauccuggccguggugagcgugagcccccugcugcugaccagcagccagcagaagaccgacuggaucccccuggcccugaccaucaagggccugaaccccaccgccaucuuccugaccacccugagcagaaccaacaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccaccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggccuguuccccaucagcauccccaucaccgccgccgccugguaccugugggaggugaagaagcagagagccggcgugcugugggacgugcccagccccccccccaugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacaagggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucaucgacaagaagggcaagguggugggccuguacggcaacggcguggugaccagaagcggcgccuacgugagcgccaucgcccagaccgagaagagcaucgaggacaaccccgagaucgaggacgacaucuucagaaagagaagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucaucgacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaagauggugcuucgacggcaucaagaacaaccagauccuggaggagaacauggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaagaccagagacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcagaggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucgccaccagacagcccgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggaccccauccccuacgaccccaaguucgagaagcagcugggccaggugaugcugcuggugcugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaugaucgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaucccccccgagaagugcgacacccugcugugcgacaucggcgagagcagccccaaccccaccguggaggccggcagaacccugagagugcugaaccugguggagaacuggcugaacaacaacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccagcggcaacaucgugagcagcgugaacaugaucagcagaaugcugaucaacagauucaccaugagacacaagaaggccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacgugcugcccaccgugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcagauucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacauggagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcguguucaagaacauccagcaccugaccgugaccgaggagguggccgugaagaacuggcuggccagagugggcagagagagacugagcagaauggccaucagcggcgacgacugcguggugaagccccuggacgacagauucgccaacgcccugaccgcccugaacgacaugggcaagaucagaaaggacauccagcagugggagcccagcaagggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugagagagaccgccugccugggcaagagcuacgcccagauguggagccugauguacuuccacagaagagaccugagacuggccgccaacgccaucugcagcgccgugcccagccacugggugcccaccagcagaaccaccuggagcauccacgccaagcacgaguggaugaccaccgaggacaugcugaccguguggaacagaguguggaucagagagaaccccuggauggaggacaagacccccguggagagcugggaggagauccccuaccugggcaagagagaggaccaguggugcggcagccugaucggccugaccagcagagccaccugggccaagaacauccaggccgccaucaaccaggugagaagccugaucggcaacgaggaguacaccgacuacaugcccagcaugaagagauucagaagagaggaggaggaggccggcgugcugugguga

SEQ ID NO: 17436 - RNA, 9876 nt, Artificial Sequence
  derived and/or modified CDS sequence (opt4) from DENV-2__FJ461305__SS-prME
agcgccggcaugaucaucaugcugauccccaccgugauggccuuccaccugaccaccagaaacggcgagccccacaugaucgugggcauccaggagaagggcaagagccugcuguucaagaccgaggacggcgugaacaugugcacccugauggccauggaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgcccagagaaucgagaccuggauccugagacaccccggcuucaccaucauggccgccauccuggccuacaccaucggcaccacccacuuccagagagugcugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaaggaggagcaggacaagagauucgugugcaagcacagcaugguggacagaggcuggggcaacggcugcggccuguucggcaagggcggcaucgugaccugcgccauguucaccugcaagaagaacauggagggcaagaucgugcagcccgagaaccuggaguacaccaucguggugaccccccacagcggcgaggagcacgccgugggcaacgacaccggcaagcacggccaggagaucaaggugaccccccagagcagcaucaccgaggccgagcugaccggcuacggcaccgugaccauggagugcagccccagaaccggccuggacuucaacgagauggugcugcugcagauggagaacaaggccuggcuggugcacagacagugguuccuggaccugccccugcccuggcugcccggcgccgacaagcaggagagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucgugaucagagugcaguacgagggcgacggcagccccugcaagauccccuucgagaucauggaccuggagaagagauacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcaucgugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccaggaggagggcaucugcggcaucagaagcgugaccagacuggagaaccugauguggaagcagaucacccccgagcugaaccacauccuggccgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagcuacaaccagaccuuccugaucgacggccccgagaccgccgagugccccaacaccaacagagccuggaacagccuggagguggaggacuacggcuucggcguguucaccaccaacaucuggcugaagcugaaggagaagcaggacgccuucugcgacagcaagcugaugagcgccgccaucaaggacaacagagccgugcacgccgacaugggcuacuggaucgagagcgcccugaacgacaccuggaagaucgagaaggccagcuucaucgaggugaagaacugccacuggcccaagagccacacccuguggagcaacggcgugcuggagagcgagaugaucauccccaagaaccuggccggccccgugagccagcacaacuacagacccggcuaccacacccagaucgccggccccuggcaccugggcaagcuggagauggacuucgacuucugcgacggcaccaccgugaucgugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugaagaccagagugggcaccaagcacgccauccugcugguggccgugagcuucgugacccugaucaccggcaacaugagcuucaaggaccugggcagagugguggugauggugggcgccaccauggccgacgacaucggcaugggcgugaccuaccuggcccugcuggccgccuucaaggugagacccaccuucgccgccggccugcugcugagaaagcugaccagcaaggagcugaugaugaccaccaucggcaucgugcugcugagccagagcaccauccccgagaccgugcuggagcugaccgacgcccuggcccugggcaugauggugcugaagaucgugagaaacauggagaaguaccagcuggccgugaccaucauggccauccugugcgugcccaacgccgugauccugcagaacgccuggaaggugagcugcaccauccuggccguggugagcgugagcccccugcugcugaccagcagccagcagaagaccgacuggaucccccuggcccugaccaucaagggccugaaccccaccgccaucuuccugaccacccugagcagaaccaacaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccaccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggccuguuccccaucagcauccccaucaccgccgccgccugguaccugugggaggugaagaagcagagagccggcgugcugugggacgugcccagccccccccccaugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacaagggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucaucgacaagaagggcaagguggugggccuguacggcaacggcguggugaccagaagcggcgccuacgugagcgccaucgcccagaccgagaagagcaucgaggacaaccccgagaucgaggacgacaucuucagaaagagaagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucaucgacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaagauggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaagaccagagacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcagaggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucgccacccagcagcccgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggaccccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaugggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaucccccccgagaagugcgacacccugcugugcgacaucggcgagagcagccccaaccccaccguggaggccggcagaacccugagagugcugaaccugguggagaacuggcugaacaacaacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccagcggcaacaucgugagcagcgugaacaugaucagcagaaugcugaucaacagauucaccaugagacacaagagagccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacgugcugcccaccgugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcagauucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacauggagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcguguucaagaacauccagcaccugaccgugaccgaggagguggccgugcagaacuggcuggccagagugggcagagagagacugagcagaauggccaucagcggcgacgacugcguggugaagccccuggacgacagauucgccaacgcccugaccgcccugaacgacaugggcaagaucagaaaggacauccagcagugggagcccagcaagggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugagagagaccgccugccugggcaagagcuacgcccagauguggagccugauguacuuccacagaagagaccugagacuggccgccaacgccaucugcagcgccgugcccagccacugggugcccaccagcagaaccaccuggagcauccacgccaagcacgaguggaugaccaccgaggacaugcugaccguguggaacagaguguggaucagagagaaccccuggauggaggacaagacccccguggagagcugggaggagauccccuaccugggcaagagagaggaccaguggugcggcagccugaucggccugaccagcagagccaccugggccaagaacauccaggccgccaucaaccaggugagaagccugaucggcaacgaggaguacaccgacuacaugcccagcaugaagagauucagaagagaggaggaggaggccggcgugcugugguga

SEQ ID NO: 17437 - RNA, 9876 nt, Artificial Sequence
  derived and/or modified CDS sequence (opt4) from DENV-2__FJ410215__SS-prME
agcgccggcaugaucaucaugcugauccccaccgugauggccuuccaccugaccaccagaaacggcgagccccacaugaucgugggcauccaggagaagggcaagagccugcuguucaagaccgaggacggcgugaacaugugcacccugauggccauggaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgcccagagaaucgagaccuggauccugagacaccccggcuucaccaucauggccgccauccuggccuacaccaucggcaccacccacuuccagagagugcugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaaggaggagcaggacaagagauucgugugcaagcacagcaugguggacagaggcuggggcaacggcugcggccuguucggcaagggcggcaucgugaccugcgccauguucaccugcaagaagaacauggagggcaagaucgugcagcccgagaaccuggaguacaccaucguggugaccccccacagcggcgaggagcacgccgugggcaacgacaccggcaagcacggcaaggagaucaaggugaccccccagagcagcaucaccgaggccgagcugaccggcuacggcaccgugaccauggagugcagccccagaaccggccuggacuucaacgagauggugcugcugcagauggagaacaaggccuggcuggugcacagacagugguuccuggaccugccccugcccuggcugcccggcgccgacaagcaggagagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucgugaucagagugcaguacgagggcgacggcagccccugcaagauccccuucgagaucauggaccuggagaagagauacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcaucgugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccaggaggagggcaucugcggcaucagaagcgugaccagacuggagaaccugauguggaagcagaucacccccgagcugaaccacauccuggccgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagcuacaaccagaccuuccugaucgacggccccgagaccgccgagugccccaacaccaacagagccuggaacagccuggagguggaggacuacggcuucggcguguucaccaccaacaucuggcugaagcugaaggagaagcaggacgccuucugcgacagcaagcugaugagcgccgccaucaaggacaacagagccgugcacgccgacaugggcuacuggaucgagagcgcccugaacgacaccuggaagaucgagaaggccagcuucaucgaggugaagaacugccacuggcccaagagccacacccuguggagcaacggcgugcuggagagcgagaugaucauccccaagaaccuggccggccccgugagccagcacaacuacagacccggcuaccacacccagaucgccggccccuggcaccugggcaagcuggagauggacuucgacuucugcgacggcaccaccgugaucgugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagguggacaacuucagccugggcgugcugggcauggcccuguuccuggaggagaugcugagaaccagagugggcaccaagcacgccauccugcugguggccgugagcuucgugacccugaucaccggcaacaugagcuucaaggaccugggcagagugguggugauggugggcgccgccauggccgacgacaucggcaugggcgugaccuaccuggcccugcuggccgccuucaaggugagacccaccuucgccgccggccugcugcugagaaagcugaccagcaaggagcugaugaugaccaccaucggcaucgugcugcugagccagagcaccauccccgagaccgugcuggagcugaccgacgcccuggcccugggcaugauggugcugaagaucgugagaaacauggagaaguaccagcuggccgugaccaucauggccauccugugcgugcccaacgccgugauccugcagaacgccuggaaggugagcugcaccauccuggccguggugagcgugagcccccugcugcugaccagcagccagcagaagaccgacuggaucccccuggcccugaccaucaagggccugaaccccaccgccaucuuccugaccacccugagcagaaccaacaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccaccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggccuguuccccaucagcauccccaucaccgccgccgccugguaccugugggaggugaagaagcagagagccggcgugcugugggacgugcccagccccccccccaugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacaagggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucaucgacaagaagggcaagguggugggccuguacggcaacggcguggugaccagaagcggcgccuacgugagcgccaucgcccagaccgagaagagcaucgaggacaaccccgagaucgaggacgacaucuucagaaagagaagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucaucgacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaagauggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaagaccagagacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcagaggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggacuucggccugggcagcaucgccacccagcagcccgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggaccccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaccuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaucccccccgagaagugcgacacccugcugugcgacaucggcgagagcagccccaaccccaccguggaggccggcagaacccugagagugcugaaccugguggagaacuggcugaacaacaacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccagcggcaacaucgugagcagcgugaacaugaucagcagaaugcugaucaacagauucaccaugagacacaagaaggccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacgugcugcccaccgugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcagauucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacauggagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcguguucaagaacauccagcaccugaccgugaccgaggagguggccgugcagaacuggcuggccagagugggcagagagagacugagcagaauggccaucagcggcgacgacugcguggugaagccccuggacgacagauucgccaacgcccugaccgcccugaacgacaugggcaagaucagaaaggacauccagcagugggagcccagcaagggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugagagagaccgccugccugggcaagagcuacgcccagauguggagccugauguacuuccacagaagagaccugagacuggccgccaacgccaucugcagcgccgugcccagccacugggugcccaccagcagaaccaccuggagcauccacgccaagcacgaguggaugaccaccgaggacaugcugaccguguggaacagaguguggaucagagagaaccccuggauggaggacaagacccccguggagagcugggaggagauccccuaccugggcaagagagaggaccaguggugcggcagccugaucggccugaccagcagagccaccugggccaagaacauccaggccgccaucaaccaggugagaagccugaucggcaacgaggaguacaccgacuacaugcccagcaugaagagauucagaagagaggaggaggaggccggcgugcugugguga

SEQ ID NO: 17438 - RNA, 9876 nt, Artificial Sequence
  derived and/or modified CDS sequence (opt4) from DENV-2__FJ461309__SS-prME
agcgccggcaugaucaucaugcugauccccaccgugauggccuuccaccugaccaccagaaacggcgagccccacaugaucgugggcauccaggagaagggcaagagccugcuguucaagaccgaggacggcgugaacaugugcacccugauggccauggaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgcccagagaaucgagaccuggauccugagacaccccggcuucaccaucauggccgccauccuggccuacaccaucggcaccacccacuuccagagagugcugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaaggaggagcaggacaagagauucgugugcaagcacagcaugguggacagaggcuggggcaacggcugcggccuguucggcaagggcggcaucgugaccugcgccauguucaccugcaagaagaacauggagggcaagaucgugcagcccgagaaccuggaguacaccaucguggugaccccccacagcggcgaggagcacgccgugggcaacgacaccggcaagcacggccaggagaucaaggugaccccccagagcagcaucaccgaggccgagcugaccggcuacggcaccgugaccauggagugcagccccagaaccggccuggacuucaacgagauggugcugcugcagauggagaacaaggccuggcuggugcacagacagugguuccuggaccugccccugcccuggcugcccggcgccgacaagcaggagagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucgugaucagagugcaguacgagggcgacggcagccccugcaagauccccuucgagaucauggaccuggagaagagauacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcaucgugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccaggaggagggcaucugcggcaucagaagcgugaccagacuggagaaccugauguggaagcagaucacccccgagcugaaccacauccuggccgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagcuacaaccagaccuuccugaucgacggccccgagaccgccgagugccccaacaccaacagagccuggaacagccuggagguggaggacuacggcuucggcguguucaccaccaacaucuggcugaagcugaaggagaagcaggacgccuucugcgacagcaagcugaugagcgccgccaucaaggacaacagagccgugcacgccgacaugggcuacuggaucgagagcgcccugaacgacaccuggaagaucgagaaggccagcuucaucgaggugaagaacugccacuggcccaagagccacacccuguggagcaacggcgugcuggagagcgagaugaucauccccaagaaccuggccggccccgugagccagcacaacuacagacccggcuaccacacccagaucgccggccccuggcaccugggcaagcuggagauggacuucgacuucugcgacggcaccaccgugaucgugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagguggacaacuucagccugggcgugcugggcauggcccuguuccuggaggagaugcugaagaccagagugggcaccaagcacgccauccugcugguggccgugagcuucgugacccugaucaccggcaacaugagcuucaaggaccugggcagagugguggugauggugggcgccaccauggccgacgacaucggcaugggcgugaccuaccuggcccugcuggccgccuucaaggugagacccaccuucgccgccggccugcugcugagaaagcugaccagcaaggagcugaugaugaccaccaucggcaucgugcugcugagccagagcaccauccccgagaccgugcuggagcugaccgacgcccuggcccugggcaugauggugcugaagaucgugagaaacauggagaaguaccagcuggccgugaccaucauggccauccugugcgugcccaacgccgugauccugcagaacgccuggaaggugagcugcaccauccuggccguggugagcgugagcccccugcugcugaccagcagccagcagaagaccgacuggaucccccuggcccugaccaucaagggccugaaccccaccgccaucuuccugaccacccugagcagaaccaacaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccaccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggccuguuccccaucagcauccccaucaccgccgccgccugguaccugugggaggugaagaagcagagagccggcgugcugugggacgugcccagccccccccccaugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacaagggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucaucgacaagaagggcaagguggugggccuguacggcaacggcguggugaccagaagcggcgccuacgugagcgccaucgcccagaccgagaagagcaucgaggacaaccccgagaucgaggacgacaucuucagaaagagaagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucaucgacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaagauggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaagaccagagacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcagaggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucgccacccagcagcccgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggaccccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaugggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaucccccccgagaagugcgacacccugcugugcgacaucggcgagagcagccccaaccccaccguggaggccggcagaacccugagagugcugaaccugguggagaacuggcugaacaacaacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccagcggcaacaucgugagcagcgugaacaugaucagcagaaugcugaucaacagauucaccaugagacacaagaaggccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacgugcugcccaccgugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacggcagauucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacauggagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcguguucaagaacauccagcaccugaccgugaccgaggagguggccgugcagaacuggcuggccagagugggcagagagagacugagcagaauggccaucagcggcgacgacugcguggugaagccccuggacgacagauucgccaacgcccugaccgcccugaacgacaugggcaagaucagaaaggacauccagcagugggagcccagcaagggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugagagagaccgccugccugggcaagagcuacgcccagauguggagccugauguacuuccacagaagagaccugagacuggccgccaacgccaucugcagcgccgugcccagccacugggugcccaccagcagaaccaccuggagcauccacgccaagcacgaguggaugaccaccgaggacaugcugaccguguggaacagaguguggaucagagagaaccccuggauggaggacaagacccccguggagagcugggaggagauccccuaccugggcaagagagaggaccaguggugcggcagccugaucggccugaccagcagagccaccugggccaagaacauccaggccgccaucaaccaggugagaagccugaucggcaacgaggaguacaccgacuacaugcccagcaugaagagauucagaagagaggaggaggaggccggcgugcugugguga

SEQ ID NO: 17439 - RNA, 9876 nt, Artificial Sequence
  derived and/or modified CDS sequence (opt4) from DENV-2__FJ461311__SS-prME
agcgccggcaugaucaucaugcugauccccaccgugauggccuuccaccugaccaccagaaacggcgagccccacaugaucgugggcauccaggagaagggcaagagccugcuguucaagaccgaggacggcgugaacaugugcacccugauggccauggaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgcccagagaaucgagaccuggauccugagacaccccggcuucaccaucauggccgccauccuggccuacaccaucggcaccacccacuuccagagagugcugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaaggaggagcaggacaagagauucgugugcaagcacagcaugguggacagaggcuggggcaacggcugcggccuguucggcaagggcggcaucgugaccugcgccauguucaccugcaagaagaacauggagggcaagaucgugcagcccgagaaccuggaguacaccaucguggugaccccccacagcggcgaggagcacgccgugggcaacgacaccggcaagcacggccaggagaucaaggugaccccccagagcagcaucaccgaggccgagcugaccggcuacggcaccgugaccauggagugcagccccagaaccggccuggacuucaacgagauggugcugcugcagauggagaacaaggccuggcuggugcacagacagugguuccuggaccugccccugcccuggcugcccggcgccgacaagcaggagagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucgugaucagagugcaguacgagggcgacggcagccccugcaagauccccuucgagaucauggaccuggagaagagauacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcaucgugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccaggaggagggcaucugcggcaucagaagcgugaccagacuggagaaccugauguggaagcagaucacccccgagcugaaccacauccuggccgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagcuacaaccagaccuuccugaucgacggccccgagaccgccgagugccccaacaccaacagagccuggaacagccuggagguggaggacuacggcuucggcguguucaccaccaacaucuggcugaagcugaaggagaagcaggacgccuucugcgacagcaagcugaugagcgccgccaucaaggacaacagagccgugcacgccgacaugggcuacuggaucgagagcgcccugaacgacaccuggaagaucgagaaggccagcuucaucgaggugaagaacugccacuggcccaagagccacacccuguggagcaacggcgugcuggagagcgagaugaucauccccaagaaccuggccggccccgugagccagcacaacuacagacccggcuaccacacccagaucgccggccccuggcaccugggcaagcuggagauggacuucaacuucugcgacggcaccaccgugaucgugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagguggacaacuucagccugggcgugcugggcauggcccuguuccuggaggagaugcugagaaccagagugggcaccaagcacgccauccugcugguggccgugagcuucgugacccugaucaccggcaacaugagcuucaaggaccugggcagagugguggugauggugggcgccaccaugaccgacgacaucggcaugggcgugaccuaccuggcccugcuggccgccuucaaggugagacccaccuucgccgccggccugcugcugagaaagcugaccagcaaggagcugaugaugaccaccaucggcaucgugcugcugagccagagcaccauccccgagaccgugcuggagcugaccgacgcccuggcccugggcaugauggugcugaagaucgugagaaacauggagaaguaccagcuggccgugaccaucauggccauccugugcgugcccaacgccgugauccugcagaacgccuggaaggugagcugcaccauccuggccguggugagcgugagcccccugcugcugaccagcagccagcagaagaccgacuggaucccccuggcccugaccaucaagggccugaaccccaccgccaucuuccugaccacccugagcagaaccaacaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccaccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggccuguuccccaucagcauccccaucaccgccgccgccugguaccugugggaggugaagaagcagagagccggcgugcugugggacgugcccagccccccccccaugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacaagggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucaucgacaagaagggcaagguggugggccuguacggcaacggcguggugaccagaagcggcgccuacgugagcgccaucgcccagaccgagaagagcaucgaggacaaccccgagaucgaggacgacaucuucagaaagagaagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucaucgacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaagauggugcuucgacggcaucaagaacaaccagauccuggaggagaacauggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaagaccagagacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcagaggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucgccaccagacagcccgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggaccccauccccuacgaccccaaguucgagaagcagcugggccaggugaugcugcuggugcugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaugggcgagacccugggcgagaaguggaagagccagcugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaucccccccgagaagugcgacacccugcugugcgacaucggcgagagcagccccaaccccaccguggaggccggcagaacccugagagugcugaaccugguggagaacuggcugaacaacaacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccagcggcaacaucgugagcagcgugaacaugaucagcagaaugcugaucaacagauucaccaugagacacaagaaggccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacgugcugcccaccgugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcagauucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacauggagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcguguucaagaacauccagcaccugaccgugaccgaggagguggccgugaagaacuggcuggccagagugggcagagagagacugagcagaauggccaucagcggcgacgacugcguggugaagccccuggacgacagauucgccaacgcccugaccgcccugaacgacaugggcaagaucagaaaggacauccagcagugggagcccagcaagggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugagagagaccgccugccugggcaagagcuacgcccagauguggagccugauguacuuccacagaagagaccugagacuggccgccaacgccaucugcagcgccgugcccagccacugggugcccaccagcagaaccaccuggagcauccacgccaagcacgaguggaugaccaccgaggacaugcugaccguguggaacagaguguggaucagagagaaccccuggauggaggacaagacccccguggagagcugggaggagauccccuaccugggcaagagagaggaccaguggugcggcagccugaucggccugaccagcagagccaccugggccaagaacauccaggccgccaucaaccaggugagaagccugaucggcaacgaggaguacaccgacuacaugcccagcaugaagagauucagaagagaggaggaggaggccggcgugcugugguga

SEQ ID NO: 17440 - RNA, 9876 nt, Artificial Sequence
  derived and/or modified CDS sequence (opt4) from DENV-2__FJ410217__SS-prME
agcgccggcaugaucaucaugcugauccccaccgugauggccuuccaccugaccaccagaaacggcgagccccacaugaucgugggcauccaggagaagggcaagagccugcuguucaagaccgaggacggcgugaacaugugcacccugauggccauggaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgcccagagaaucgagaccuggauccugagacaccccggcuucaccaucauggccgccauccuggccuacaccaucggcaccacccacuuccagagagugcugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaaggaggagcaggacaagagauucgugugcaagcacagcaugguggacagaggcuggggcaacggcugcggccuguucggcaagggcggcaucgugaccugcgccauguucaccugcaagaagaacauggagggcaagaucgugcagcccgagaaccuggaguacaccaucguggugaccccccacagcggcgaggagcacgccgugggcaacgacaccggcaagcacggcaaggagaucaaggugaccccccagagcagcaucaccgaggccgagcugaccggcuacggcaccgugaccauggagugcagccccagaaccggccuggacuucaacgagauggugcugcugcagauggagaacaaggccuggcuggugcacagacagugguuccuggaccugccccugcccuggcugcccggcgccgacaagcaggagagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucgugaucagagugcaguacgagggcgacggcagccccugcaagauccccuucgagaucauggaccuggagaagagauacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcaucgugacccuguaccugggcgugauggugcaggccgacagcggcugcaucgugagcuggaagaacaaggagcugaagugcggcagcggcaucuucgugaccgacaacgugcacaccuggaccgagcaguacaaguuccagcccgagagccccagcaagcuggccagcgccauccagaaggcccaggaggagggcaucugcggcaucagaagcgugaccagacuggagaaccugauguggaagcagaucacccccgagcugaaccacauccuggccgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucaccaccaacaucuggcugagacugaaggagaagcaggacgccuucugcgacagcaagcugaugagcgccgccaucaaggacaacagagccgugcacgccgacaugggcuacuggaucgagagcgcccugaacgacaccuggaagaucgagaaggccagcuucaucgaggugaagaacugccacuggcccaagagccacacccuguggagcaacggcgugcuggagagcgagaugaucauccccaagaaccuggccggccccgugagccagcacaacuacagacccggcuaccacacccagaucgccggccccuggcaccugggcaagcuggagauggacuucgacuucugcgacggcaccaccgugaucgugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagguggacaacuucagccugggcgugcugggcauggcccuguuccuggaggagaugcugagaaccagagugggcaccaagcacgccauccugcugguggccgugagcuucgugacccugaucaccggcaacaugagcuucaaggaccugggcagagugguggugauggugggcgccaccauggccgacgacaucggcaugggcgugaccuaccuggcccugcuggccgccuucaaggugagacccaccuucgccgccggccugcugcugagaaagcugaccagcaaggagcugaugaugaccaccaucggcaucgugcugcugagccagagcaccauccccgagaccgugcuggagcugaccgacgcccuggcccugggcaugauggugcugaagaucgugagaaacauggagaaguaccagcuggccgugaccaucauggccauccugugcgugcccaacgccgugauccugcagaacgccuggaaggugagcugcaccauccuggccguggugagcgugagcccccugcugcugaccagcagccagcagaagaccgacuggaucccccuggcccugaccaucaagggccugaaccccaccgccaucuuccugaccacccugagcagaaccaacaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccaccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggccuguuccccaucagcauccccaucaccgccgccgccugguaccugugggaggugaagaagcagagagccggcgugcugugggacgugcccagccccccccccaugggcaaggccgagcuggaggacggcgccuacagaaucaagcagaagggcaucuucggcuacagccagaucggcgccggcguguacaaggagggcaccuuccacaccauguggcacgugaccagaggcgccgugcugaugcacaagggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucaucgacaagaagggcaagguggugggccuguacggcaacggcguggugaccagaagcggcgccuacgugagcgccaucgcccagaccgagaagagcaucgaggacaaccccgagaucgaggacgacaucuucagaaagagaagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucaucgacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagaaccaacgacugggacuucguggugaccaccgacaucagcgagaugggcgccaacuucaaggccgagagagugaucgaccccagaagaugcaugaagcccgugauccuggccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaagauggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaagaccagagacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcagaggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucgccacccagcagcccgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggaccccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacgccagaagaggcaccggcaacaugggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaucccccccgagaagugcgacacccugcugugcgacaucggcgagagcagccccaaccccaccguggaggccggcagaacccugagagugcugaaccugguggagaacuggcugaacaacaacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccagcggcaacaucgugagcagcgugaacaugaucagcagaaugcugaucaacagauucaccaugagacacaagaaggccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacgugcugcccaccgugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcagauucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacauggagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcguguucaagaacauccagcaccugaccgugaccgaggagguggccgugcagaacuggcuggccagagugggcagagagagacugagcagaauggccaucagcggcgacgacugcguggugaagccccuggacgacagauucgccaacgcccugaccgcccugaacgacaugggcaagaucagaaaggacauccagcagugggagcccagcaagggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugagagagaccgccugccugggcaagagcuacgcccagauguggagccugauguacuuccacagaagagaccugagacuggccgccaacgccaucugcagcgccgugcccagccacugggugcccaccagcagaaccaccuggagcauccacgccaagcacgaguggaugaccaccgaggacaugcugaccguguggaacagaguguggaucagagagaaccccuggauggaggacaagacccccguggagagcugggaggagauccccuaccugggcaagagagaggaccaguggugcggcagccugaucggccugaccagcagagccaccugggccaagaacauccaggccgccaucaaccaggugagaagccugaucggcaacgaggaguacaccgacuacaugcccagcaugaagagauucagaagagaggaggaggaggccggcgugcugugguga

SEQ ID NO: 17441 - RNA, 9876 nt, Artificial Sequence
  derived and/or modified CDS sequence (opt4) from DENV-2__FJ410219__SS-prME
agcgccggcaugaucaucaugcugauccccaccgugauggccuuccaccugaccaccagaaacggcgagccccacaugaucgugggcauccaggagaagggcaagagccugcuguucaagaccgaggacggcgugaacaugugcacccugauggccauggaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgcccagagaaucgagaccuggauccugagacaccccggcuucaccaucauggccgccauccuggccuacaccaucggcaccacccacuuccagagagugcugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaaggaggagcaggacaagagauucgugugcaagcacagcaugguggacagaggcuggggcaacggcugcggccuguucggcaagggcggcaucgugaccugcgccauguucaccugcaagaagaacauggagggcaagaucgugcagcccgagaaccuggaguacaccaucguggugaccccccacagcggcgaggagcacgccgugggcaacgacaccggcaagcacggccaggagaucaaggugaccccccagagcagcaucaccgaggccgagcugaccggcuacggcaccgugaccauggagugcagccccagaaccggccuggacuucaacgagauggugcugcugcagauggagaacaaggccuggcuggugcacagacagugguuccuggaccugccccugcccuggcugcccggcgccgacaagcaggagagcaacuggauccagaaggagacccuggugaccuucaagaacccccacgccaagaagcaggacgugguggugcugggcagccaggagggcgccaugcacaccgcccugaccggcgccaccgagauccugaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucgugaucagagugcaguacgagggcgacggcagccccugcaagauccccuucgagaucauggaccuggagaagagauacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcaucgugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccaggaggagggcaucugcggcaucagaagcgugaccagacuggagaaccugauguggaagcagaucacccccgagcugaaccacauccuggccgagaacgaggugaagcugaccaucaugaccggcgacaucaagggcaucaugcaggccggcaagagauuccugagaccccagcccaccgagcugaaguacagcuggaagaccuggggcaaggccaagaugcugagcaccgagagcuacaaccagaccuuccugaucgacggccccgagaccgccgagugccccaacaccaacagagccuggaacagccuggagguggaggacuacggcuucggcguguucaccaccaacaucuggcugaagcugaaggagaagcaggacgccuucugcgacagcaagcugaugagcgccgccaucaaggacaacagagccgugcacgccgacaugggcuacuggaucgagagcgcccugaacgacaccuggaagaucgagaaggccagcuucaucgaggugaagaacugccacuggcccaagagccacacccuguggagcaacggcgugcuggagagcgagaugaucauccccaagaaccuggccggccccgugagccagcacaacuacagacccggcuaccacacccagaucgccggccccuggcaccugggcaagcuggagauggacuucgacuucugcgacggcaccaccgugaucgugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagguggacaacuucagccugggcgugcugggcauggcccuguuccuggaggagaugcugagaaccagagugggcaugaagcacgccauccugcugguggccgugagcuucgugacccugaucaccggcaacaugagcuucaaggaccugggcagagugguggugauggugggcgccaccaugaccgacgacaucggcaugggcgugaccuaccuggcccugcuggccgccuucaaggugagacccaccuucgccgccggccugcugcugagaaagcugaccagcaaggagcugaugaugaucaccaucggcaucgugcugcugagccagagcaccauccccgagaccgugcuggagcugaccgacgcccuggcccugggcaugauggugcugaagaucgugagaaacauggagaaguaccagcuggccgugaccaucauggccauccugugcgugcccaacgccgugauccugcagaacgccuggaaggugagcugcaccauccuggccguggugagcgugagcccccugcugcugaccagcagccagcagaagaccgacuggaucccccuggcccugaccaucaagggccugaaccccaccgccaucuuccugaccacccugagcagaaccaacaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagugaccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggccuguuccccaucagcauccccaucaccgccgccgccugguaccugugggaggugaagaagcagagagccggcgugcugugggacgugcccagccccccccccaugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacaagggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucaucgacaagaagggcaagguggugggccuguacggcaacggcguggugaccagaagcggcgccuacgugagcgccaucgcccagaccgagaagagcaucgaggacaaccccgagaucgaggacgacaucuucagaaagagaagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucaucgacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaagauggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaagaccagagacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcagaggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucgccacccagcagcccgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggaccccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaugggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaucccccccgagaagugcgacacccugcugugcgacaucggcgagagcagccccaaccccaccguggaggccggcagaacccugagagugcugaaccugguggagaacuggcugaacaacaacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccagcggcaacaucgugagcagcgugaacaugaucagcagaaugcugaucaacagauucaccaugagacacaagaaggccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacgugcugcccaccgugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcagauucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacauggagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcguguucaagaacauccagcaccugaccgugaccgaggagguggccgugaagaacuggcuggccagagugggcagagagagacugagcagaauggccaucagcggcgacgacugcguggugaagccccuggacgacagauucgccaacgcccugaccgcccugaacgacaugggcaagaucagaaaggacauccagcagugggagcccagcaagggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugagagagaccgccugccugggcaagagcuacgcccagauguggagccugauguacuuccacagaagagaccugagacuggccgccaacgccaucugcagcgccgugcccagccacugggugcccaccagcagaaccaccuggagcauccacgccaagcacgaguggaugaccaccgaggacaugcugaccguguggaacagaguguggaucagagagaaccccuggauggaggacaagacccccguggagagcugggaggagauccccuaccugggcaagagagaggaccaguggugcggcagccugaucggccugaccagcagagccaccugggccaagaacauccaggccgccaucaaccaggugagaagccugaucggcaacgaggaguacaccgacuacaugcccagcaugaagagauucagaagagaggaggaggaggccggcgugcugugguga

SEQ ID NO: 17442 - RNA, 9876 nt, Artificial Sequence
  derived and/or modified CDS sequence (opt4) from DENV-2__FJ461314__SS-prME
agcgccggcaugaucaucaugcugauccccaccgugauggccuuccaccugaccaccagaaacggcgagccccacaugaucgugggcauccaggagaagggcaagagccugcuguucaagaccgaggacggcgugaacaugugcacccugauggccauggaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgcccagagaaucgagaccuggauccugagacaccccggcuucaccaucauggccgccauccuggccuacaccaucggcaccacccacuuccagagagugcugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaaggaggagcaggacaagagauucgugugcaagcacagcaugguggacagaggcuggggcaacggcugcggccuguucggcaagggcggcaucgugaccugcgccauguucaccugcaagaagaacauggagggcaagaucgugcagcccgagaaccuggaguacaccaucguggugaccccccacagcggcgaggagcacgccgugggcaacgacaccggcaagcacggccaggagaucaaggugaccccccagagcagcaucaccgaggccgagcugaccggcuacggcaccgugaccauggagugcagccccagaaccggccuggacuucaacgagauggugcugcugcagauggagaacaaggccuggcuggugcacagacagugguuccuggaccugccccugcccuggcugcccggcgccgacaagcaggagagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucgugaucagagugcaguacgagggcgacggcagccccugcaagauccccuucgagaucauggaccuggagaagagauacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggacccugaagauccugaucggcgugaucaucaccuggaucggcaugaacagcagaagcaccagccugagcgugagccuggugcuggugggcaucgugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccaggaggagggcaucugcggcaucagaagcgugaccagacuggagaaccugauguggaagcagaucacccccgagcugaaccacauccuggccgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagcuacaaccagaccuuccugaucgacggccccgagaccgccgagugccccaacaccaacagagccuggaacagccuggagguggaggacuacggcuucggcguguucaccaccaacaucuggcugaagcugaaggagaagcaggacgccuucugcgacagcaagcugaugagcgccgccaucaaggacaacagagccgugcacgccgacaugggcuacuggaucgagagcgcccugaacgacaccuggaagaucgagaaggccagcuucaucgaggugaagaacugccacuggcccaagagccacacccuguggagcaacggcgugcuggagagcgagaugaucauccccaagaaccuggccggccccgugagccagcacaacuacagacccggcuaccacacccagaucgccggccccuggcaccugggcaagcuggagauggacuucgacuucugcgacggcaccaccgugaucgugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagguggacaacuucagccugggcgugcugggcauggcccuguuccuggaggagaugcugagaaccagagugggcaccaagcacgccauccugcugguggccgugagcuucgugacccugaucaccggcaacaugagcuucaaggaccugggcagagugguggugauggugggcgccaccauggccgacgacaucggcaugggcgugaccuaccuggcccugcuggccgccuucaaggugagacccaccuucgccgccggccugcugcugagaaagcugaccagcaaggagcugaugaugaccaccaucggcaucgugcugcugagccagagcaccauccccgagaccgugcuggagcugaccgacgcccuggcccugggcaugauggugcugaagaucgugagaaacauggagaaguaccagcuggccgugaccaucauggccauccugugcgugcccaacgccgugauccugcagaacgccuggaaggugagcugcaccauccuggccguggugagcgugagcccccugcugcugaccagcagccagcagaagaccgacuggaucccccuggcccugaccaucaagggccugaaccccaccgccaucuuccugaccacccugagcagaaccaacaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccaccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggccuguuccccaucagcauccccaucaccgccgccgccugguaccugugggaggugaagaagcagagagccggcgugcugugggacgugcccagccccccccccaugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacaagggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucaucgacaagaagggcaagguggugggccuguacggcaacggcguggugaccagaagcggcgccuacgugagcgccaucgcccagaccgagaagagcaucgaggacaaccccgagaucgaggacgacaucuucagaaagagaagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucaucgacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaagauggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaagaccagagacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcagaggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucgccacccagcagcccgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggaccccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaugggcgagacccugggcgagaaguggaagagcagacugaacacccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaucccccccgagaagugcgacacccugcugugcgacaucggcgagagcagccccaaccccaccguggaggccggcagaacccugagagugcugaaccugguggagaacuggcugaacaacaacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccagcggcaacaucgugagcagcgugaacaugaucagcagaaugcugaucaacagauucaccaugagacacaagaaggccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacgugcugcccaccgugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcagauucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacauggagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcguguucaagaacauccagcaccugaccgugaccgaggagguggccgugcagaacuggcuggccagagugggcagagagagacugagcagaauggccaucagcggcgacgacugcguggugaagccccuggacgacagauucgccaacgcccugaccgcccugaacgacaugggcaagaucagaaaggacauccagcagugggagcccagcaagggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugagagagaccgccugccugggcaagagcuacgcccagauguggagccugauguacuuccacagaagagaccugagacuggccgccaacgccaucugcagcgccgugcccagccacugggugcccaccagcagaaccaccuggagcauccacgccaagcacgaguggaugaccaccgaggacaugcugaccguguggaacagaguguggaucagagagaaccccuggauggaggacaagacccccguggagagcugggaggagauccccuaccugggcaagagagaggaccaguggugcggcagccugaucggccugaccagcagagccaccugggccaagaacauccaggccgccaucaaccaggugagaagccugaucggcaacgaggaguacaccgacuacaugcccagcaugaagagauucagaagagaggaggaggaggccggcgugcugugguga

SEQ ID NO: 17443 - RNA, 9876 nt, Artificial Sequence
  derived and/or modified CDS sequence (opt4) from DENV-2__FJ410221__SS-prME
agcgccggcaugaucaucaugcugauccccaccgugauggccuuccaccugaccaccagaaacggcgagccccacaugaucgugggcauccaggagaagggcaagagccugcuguucaagaccgaggacggcgugaacaugugcacccugauggccauggaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgcccagagaaucgagaccuggauccugagacaccccggcuucaccaucauggccgccauccuggccuacaccaucggcaccacccacuuccagagagugcugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaaggaggagcaggacaagagauucgugugcaagcacagcaugguggacagaggcuggggcaacggcugcggccuguucggcaagggcggcaucgugaccugcgccauguucaccugcaagaagaacauggagggcaagaucgugcagcccgagaaccuggaguacaccaucguggugaccccccacagcggcgaggagcacgccgugggcaacgacaccggcaagcacggcaaggagaucaaggugaccccccagagcagcaucaccgaggccgagcugaccggcuacggcaccgugaccauggagugcagccccagaaccggccuggacuucaacgagauggugcugcugcagauggagaacaaggccuggcuggugcacagacagugguuccuggaccugccccugcccuggcugcccggcgccgacaagcaggagagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucgugaucagagugcaguacgagggcgacggcagccccugcaagauccccuucgagaucauggaccuggagaagagauacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcaucgugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccaggaggagggcaucugcggcaucagaagcgugaccagacuggagaaccugauguggaagcagaucacccccgagcugaaccacauccuggccgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagcuacaaccagaccuuccugaucgacggccccgagaccgccgagugccccaacaccaacagagccuggaacagccuggagguggaggacuacggcuucggcguguucaccaccaacaucuggcugaagcugaaggagaagcaggacgccuucugcgacagcaagcugaugagcgccgccaucaaggacaacagagccgugcacgccgacaugggcuacuggaucgagagcgcccugaacgacaccuggaagaucgagaaggccagcuucaucgaggugaagaacugccacuggcccaagagccacacccuguggagcaacggcgugcuggagagcgagaugaucauccccaagaaccuggccggccccgugagccagcacaacuacagacccggcuaccacacccagaucgccggccccuggcaccugggcaagcuggagauggacuucgacuucugcgacggcaccaccgugaucgugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagguggacaacuucagccugggcgugcugggcauggcccuguuccuggaggagaugcugagaaccagagugggcaccaagcacgccauccugcugguggccgugagcuucgugacccugaucaccggcaacaugagcuucaaggaccugggcagagugguggugauggugggcgccaucauggccgacgacaucggcaucggcgugaccuaccuggcccugcuggccgccuucaaggugagacccaccuucgccgccggccugcugcugagaaagcugaccagcaaggagcugaugaugaccaccaucggcaucgugcugcugagccagagcaccauccccgagaccgugcuggagcugaccgacgcccuggcccugggcaugauggugcugaagaucgugagaaacauggagaaguaccagcuggccgugaccaucauggccauccugugcgugcccaacgccgugauccugcagaacgccuggaaggugagcugcaccauccuggccguggugagcgugagcccccugcugcugaccagcagccagcagaagaccgacuggaucccccuggcccugaccaucaagggccugaaccccaccgccaucuuccugaccacccugagcagaaccaacaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccaccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggccuguuccccaucagcauccccaucaccgccgccgccugguaccugugggaggugaagaagcagagagccggcgugcugugggacgugcccagccccccccccaugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacaagggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucaucgacaagaagggcaagguggugggccuguacggcaacggcguggugaccagaagcggcgccuacgugagcgccaucgcccagagcgagaagagcaucgaggacaaccccgagaucgaggacgacaucuucagaaagagaagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagaguggagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucaucgacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaagauggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaagaccagagacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcagaggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucgccacccagcagcccgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggaccccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaucccccccgagaagugcgacacccugcugugcgacaucggcgagagcagccccaaccccaccguggaggccggcagaacccugagagugcugaaccugguggagaacuggcugaacaacaacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccagcggcaacaucgugagcagcgugaacaugaucagcagaaugcugaucaacagauucaccaugagacacaagaaggccaccuacgagcccgacguggaccugggcagcggcaccagaaacgugggcaucgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacgugcugcccaccgugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcagauucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacauggagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcguguucaagaacauccagcaccugaccgugaccgaggagguggccgugcagaacuggcuggccagagugggcagagagagacugagcagaauggccaucagcggcgacgacugcguggugaagccccuggacgacagauucgccaacgcccugaccgcccugaacgacaugggcaagaucagaaaggacauccagcagugggagcccagcaagggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugagagagaccgccugccugggcaagagcuacgcccagauguggagccugauguacuuccacagaagagaccugagacuggccgccaacgccaucugcagcgccgugcccagccacugggugcccaccagcagaaccaccuggagcauccacgccaagcacgaguggaugaccaccgaggacaugcugaccguguggaacagaguguggaucagagagaaccccuggauggaggacaagacccccguggagagcugggaggagauccccuaccugggcaagagagaggaccaguggugcggcagccugaucggccugaccagcagagccaccugggccaagaacauccaggccgccaucaaccaggugagaagccugaucggcaacgaggaguacaccgacuacaugcccagcaugaagagauucagaagagaggaggaggaggccggcgugcugugguga

SEQ ID NO: 17444 - RNA, 9876 nt, Artificial Sequence
  derived and/or modified CDS sequence (opt4) from DENV-2__FJ547064__SS-prME
agcgccggcaugaucaucaugcugauccccaccgugauggccuuccaccugaccaccagaaacggcgagccccacaugguggugggcauccaggagaagggcaagagccugcuguucaagaccgaggacggcgugaacaugugcacccugauggccauggaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgcccagagaaucgagaccuggauccugagacaccccggcuucaccaucauggccgccauccuggccuacaccaucggcaccacccacuuccagagagugcugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaaggaggagcaggacaagagauucgugugcaagcacagcaugguggacagaggcuggggcaacggcugcggccuguucggcaagggcggcaucgugaccugcgccauguucaccugcaagaagaacauggagggcaagaucgugcagcccgagaaccuggaguacaccaucguggugaccccccacagcggcgaggagcacgccgugggcaacgacaccggcaagcacggccaggagaucaaggugaccccccagagcagcaucaccgaggccgagcugaccggcuacggcaccgugaccauggagugcagccccagaaccggccuggacuucaacgagauggugcugcugcagauggagaacaaggccuggcuggugcacagacagugguuccuggaccugccccugcccuggcugcccggcgccgacaagcaggagagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucgugaucagagugcaguacgagggcgacggcagccccugcaagauccccuucgagaucauggaccuggagaagagauacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcaucgugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccaggaggagggcaucugcggcaucagaagcgugaccagacuggagaaccugauguggaagcagaucacccccgagcugaaccacauccuggccgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagcuacaaccagaccuuccugaucgacggccccgagaccgccgagugccccaacaccaacagagccuggaacagccuggagguggaggacuacggcuucggcguguucaccaccaacaucuggcugaagcugaaggagaagcaggacgccuucugcgacagcaagcugaugagcgccgccaucaaggacaacagagccgugcacgccgacaugggcuacuggaucgagagcgcccugaacgacaccuggaagaucgagaaggccagcuucaucgaggugaagaacugccacuggcccaagagccacacccuguggagcaacggcgugcuggagagcgagaugaucauccccaagaaccuggccggccccgugagccagcacaacuacagacccggcuaccacacccagaucgccggccccuggcaccugggcaagcuggagauggacuucgacuucugcgacggcaccaccgugaucgugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagguggacaacuucagccugggcgugcugggcauggcccuguuccuggaggagaugcugagaaccagagugggcaccaagcacgccauccugcugguggccgugagcuucgugacccugaucaccggcaacaugagcuucaaggaccugggcagagugguggugauggugggcgccaccaugaccgacgacaucggcaugggcgugaccuaccuggcccugcuggccgccuucaaggugagacccaccuucgccgccggccugcugcugagaaagcugaccagcaaggagcugaugaugaccaccaucggcaucgugcugcugagccagagcaccauccccgagaccgugcuggagcugaccgacgcccuggcccugggcaugauggugcugaagaucgugagaaacauggagaaguaccagcuggccgugaccaucauggccauccugugcgugcccaacgccgugauccugcagaacgccuggaaggugagcugcaccauccuggccguggugagcgugagcccccugcugcugaccagcagccagcagaagaccgacuggaucccccuggcccugaccaucaagggccugaaccccaccgccaucuuccugaccacccugagcagaaccaacaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccaccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggccuguuccccaucagcauccccaucaccgccgccgccugguaccugugggaggugaagaagcagagagccggcgugcugugggacgugcccagccccccccccaugggcaaggccgagcuggaggacggcgccuacagaaucaagcagaagggcauccugggcuacagccagaucggcgccggcguguacagagagggcaccuuccacaccauguggcacgugaccagaggcgccgugcugaugcacaagggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucaucgacaagaagggcaagguggugggccuguacggcaacggcguggugaccagaagcggcgccuacgugagcgccaucgcccagaccgagaagagcaucgaggacaaccccgagaucgaggacgacaucuucagaaagagaagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucaucgacgaggagagagagauccccgagagaagcuggaacagcggccacgagugggugaccgacuucaagggcaagaccgugugguucgugcccagcaucaaggccggcaacgacaucguggccugccugagaaagaacggcaagaaggugauccagcugagcagaaagaccuucgacagcgaguacgugaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaagauggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaagaccagagacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcagaggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucgccacccagcagcccgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggaccccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaugggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaucccccccgagaagugcgacacccugcugugcgacaucggcgagagcagccccaaccccaccguggaggccggcagaacccugagagugcugaaccugguggagaacuggcugaacaacaacauccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccagcggcaacaucgugagcagcgugaacaugaucagcagaaugcugaucaacagauucaccaugagacacaagaaggccaccuacgagcccgacguggaccugggcagcggcaccagaaacaucggcaccgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacgugcugcccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcagauucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacauggagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcguguucaagaacauccagcaccugaccgugaccgaggagguggccgugaagaacuggcuggccagagugggcagagagagacugagcagaauggccaucagcggcgacgacugcguggugaagccccuggacgacagauucgccaacgcccugaccgcccugaacgacaugggcaagaucagaaaggacauccagcagugggagcccagcaagggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugagagagaccgccugccugggcaagagcuacgcccagauguggagccugauguacuuccacagaagagaccugagacuggccgccaacgccaucugcagcgccgugcccagccacugggugcccaccagcagaaccaccuggagcauccacgccaagcacgaguggaugaccaccgaggacaugcugaccguguggaacagaguguggaucagagagaaccccuggauggaggacaagacccccguggagagcugggaggagauccccuaccugggcaagagagaggaccaguggugcggcagccugaucggccugaccagcagagccaccugggccaagaacauccaggccgccaucaaccaggugagaagccugaucggcaacgaggaguacaccgacuacaugcccagcaugaagagauucagaagagaggaggaggaggccggcgugcugugguga

SEQ ID NO: 17445 - RNA, 9876 nt, Artificial Sequence
  derived and/or modified CDS sequence (opt4) from DENV-2__FJ410223__SS-prME
agcgccggcaugaucaucaugcugauccccaccgugauggccuuccaccugaccaccagaaacggcgagccccacaugaucgugggcauccaggagaagggcaagagccugcuguucaagaccgaggacggcgugaacaugugcacccugauggccauggaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgcccagagaaucgagaccuggauccugagacaccccggcuucaccaucauggccgccauccuggccuacaccaucggcaccacccacuuccagagagugcugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaaggaggagcaggacaagagauucgugugcaagcacagcaugguggacagaggcuggggcaacggcugcggccuguucggcaagggcggcaucgugaccugcgccauguucaccugcaagaagaacauggagggcaagaucgugcagcccgagaaccuggaguacaccaucguggugaccccccacagcggcgaggagcacgccgugggcaacgacaccggcaagcacggccaggagaucaaggugaccccccagagcagcaucaccgaggccgagcugaccggcuacggcaccgugaccauggagugcagccccagaaccggccuggacuucaacgagauggugcugcugcagauggagaacaaggccuggcuggugcacagacagugguuccuggaccugccccugcccuggcugcccggcgccgacaagcaggagagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucgugaucagagugcaguacgagggcgacggcagccccugcaagauccccuucgagaucauggaccuggagaagagauacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcaucgugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccaggaggagggcaucugcggcaucagaagcgugaccagacuggagaaccugauguggaagcagaucacccccgagcugaaccacauccuggccgagaacgaggugaagcugaccaucaugaccggcgacaucaagggcaucaugcaggccggcaagagaagccugagaccccagcccaccgagcugaaguacagcuggagaaccuggggcaaggccaagaugcugagcaccgagagcuacaaccagaccuuccugaucgacggccccgagaccgccgagugccccaacaccaacagagccuggaacagccuggagguggaggacuacggcuucggcguguucaccaccaacaucuggcugaagcugaaggagaagcaggacgccuucugcgacagcaagcugaugagcgccgccaucaaggacaacagagccgugcacgccgacaugggcuacuggaucgagagcgcccugaacgacaccuggaagaucgagaaggccagcuucaucgaggugaagaacugccacuggcccaagagccacacccuguggagcaacggcgugcuggagagcgagaugaucauccccaagaaccuggccggccccgugagccagcacaacuacagacccggcuaccacacccagaucgccggccccuggcaccugggcaagcuggagauggacuucgacuucugcgacggcaccaccgugaucgugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagguggacaacuucagccugggcgugcugggcauggcccuguuccuggaggagaugcugagaaccagagugggcaccaagcacgccauccugcugguggccgugagcuucgugacccugaucaccggcaacaugagcuucaaggaccugggcagagugguggugauggugggcgccaccauggccgacgacaucggcaugggcgugaccuaccuggcccugcuggccgccuucaaggugagacccaccuucgccgccggccugcugcugagaaagcugaccagcaaggagcugaugaugaccaccaucggcaucgugcugcugagccagagcaccauccccgagaccgugcuggagcugaccgacgcccuggcccugggcaugauggugcugaagaucgugagaaacauggagaaguaccagcuggccgugaccaucauggccauccugugcgugcccaacgccgugauccugcagaacgccuggaaggugagcugcaccauccuggccguggugagcgugagcccccugcugcugaccagcagccagcagaagaccgacuggaucccccuggcccugaccaucaagggccugaaccccaccgccaucuuccugaccacccugagcagaaccaacaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccaccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggccuguuccccaucagcauccccaucaccgccgccgccugguaccugugggaggugaagaagcagagagccggcgugcugugggacgugcccagccccccccccaugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacaagggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucaucgacaagaagggcaagguggugggccuguacggcaacggcguggugaccagaagcggcgccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucaucgacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaagauggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaagaccagagacgcccuggacaaccuggccgugcugcacaccgccgaggccggcggcagagccuacaaccacgcccugagcgagcugcccgagacccuggagacccugcugcugcuggcccugcuggccaccgugaccggcggcaucuuccuguuccugaugagcggcagaggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucgccacccagcagcccgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggaccccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaugggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaucccccccgagaagugcgacacccugcugugcgacaucggcgagagcagccccaaccccaccguggaggccggcagaacccugagagugcugaaccugguggagaacuggcugaacaacaacacccaguucugcaucaaggugcugaaccccuacaugcccagcgugaucgagaagauggaggcccugcagagaaaguacggcggcgcccuggugagaaacccccugagcggcaaccugaagaacgagauguacugggugagcaacgccagcggcaacaucgugagcagcgugaacaugaucagcagaaugcugaucaacagauucaccaugagacacaagaaggccaccuacgagcccgacguggaccugggcagcggcaccagaaacaucggcaucgagagcgagacccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacgugcugcccaccgugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcagauucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacauggagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcguguucaagaacauccagcaccugaccgugaccgaggagguggccgugcagaacuggcuggccagagugggcagagagagacugagcagaauggccaucagcggcgacgacugcguggugaagccccuggacgacagauucgccaacgcccugaccgcccugaacgacaugggcaagaucagaaaggacauccagcagugggagcccagcaagggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugagagagaccgccugccugggcaagagcuacgcccagauguggagccugauguacuuccacagaagagaccugagacugguggccaacgccaucugcagcgccgugcccagccacugggugcccaccagcagaaccaccuggagcauccacgccaagcacgaguggaugaccaccgaggacaugcugaccguguggaacagaguguggaucagagagaaccccuggauggaggacaagacccccguggagagcugggaggagauccccuaccugggcaagagagaggaccaguggugcggcagccugaucggccugaccagcagagccaccugggccaagaacauccaggccgccaucaaccaggugagaagccugaucggcaacgaggaguacaccgacuacaugcccagcaugaagagauucagaagagaggaggaggaggccggcgugcugugguga

SEQ ID NO: 17446 - RNA, 9876 nt, Artificial Sequence
  derived and/or modified CDS sequence (opt4) from DENV-2__FJ410224__SS-prME
agcgccggcaugaucaucaugcugauccccaccgugauggccuuccaccugaccaccagaaacggcgagccccacaugaucgugggcauccaggagaagggcaagagccugcuguucaagaccgaggacggcgugaacaugugcacccugauggccauggaccugggcgagcugugcgaggacaccgugaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgcccagagaaucgagaccuggauccugagacaccccggcuucaccaucauggccgccauccuggccuacaccaucggcaccacccacuuccagagagugcugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaaggaggagcaggacaagagauucgugugcaagcacagcaugguggacagaggcuggggcaacggcugcggccuguucggcaagggcggcaucgugaccugcgccauguucaccugcaagaagaacauggagggcaagaucgugcagcccgagaaccuggaguacaccaucguggugaccccccacagcggcgaggagcacgccgugggcaacgacaccggcaagcacggcaaggagaucaaggugaccccccagagcagcaucaccgaggccgagcugaccggcuacggcaccgugaccauggagugcagccccagaaccggccuggacuucaacgagauggugcugcugcagauggagaacaaggccuggcuggugcacagacagugguuccuggaccugccccugcccuggcugcccggcgccgacaagcaggagagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucgugaucagagugcaguacgagggcgacggcagccccugcaagauccccuucgagaucauggaccuggagaagagauacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcaccgugacccuguaccugggcgugauggugcaggccgacagcggcugcguggugagcuggaagagcaaggagcugaagugcggcagcggcaucuucaucaccgacaacgugcacaccuggaccgagcaguacaaguuccagcccgagagccccagcaagcuggccagcgccauccagaaggcccaggaggagggcaucugcggcaucagaagcgugaccagacuggagaaccugauguggaagcagaucacccccgagcugaaccacauccuggccgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagcuacaaccagaccuuccugaucgacggccccgagaccgccgagugccccaacaccaacagagccuggaacagccuggagguggaggacuacggcuucggcguguucaccaccaacaucuggcugaagcugaaggagaagcaggacgccuucugcgacagcaagcugaugagcgccgccaucaaggacaacagagccgugcacgccgacaugggcuacuggaucgagagcgcccugaacgacaccuggaagaucgagaaggccagcuucaucgaggugaagaacugccacuggcccaagagccacacccuguggagcaacggcgugcuggagagcgagaugaucauccccaagaaccuggccggccccgugagccagcacaacuacagacccggcuaccacacccagaucgccggccccuggcaccugggcaagcuggagauggacuucgacuucugcgacggcaccaccgugaucgugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagguggacaacuucagccugggcgugcugggcauggcccuguuccuggaggagaugcugagaaccagagugggcaccaagcacgccauccugcugguggccgugagcuucgugacccugaucaccggcaacaugagcuucaaggaccugggcagagugguggugauggugggcgccaccauggccgacgacaucggcaugggcgugaccuaccuggcccugcuggccgccuucaaggugagacccaccuucgccgccggccugcugcugagaaagcugaccagcaaggagcugaugaugaccaccaucggcaucgugcugcugagccagagcaccauccccgagaccgugcuggagcugaccgacgcccuggcccugggcaugauggugcugaagaucgugagaaacauggagaaguaccagcuggccgugaccaucauggccauccugugcgugcccaacgccgugauccugcagaacgccuggaaggugagcugcaccauccuggccguggugagcgugagcccccugcugcugaccagcagccagcagaagaccgacuggaucccccuggcccugaccaucaagggccugaaccccaccgccaucuuccugaccacccugagcagaaccaacaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccaccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggccuguuccccaucagcauccccaucaccgccgccgccugguaccugugggaggugaagaagcagagagccggcgugcugugggacgugcccagccccccccccaugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacaagggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucaucgacaagaagggcaagguggugggccuguacggcaacggcguggugaccagaagcggcgccuacgugagcgccaucgcccagaccgagaagagcaucgaggacaaccccgagaucgaggacgacaucuucagaaagagaagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucaucgacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaagauggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaagaccagagacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcagaggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucgccacccagcagcccgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggaccccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaccuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaucccccccgagaagugcgacacccugcugugcgacaucggcgagagcagccccaaccccaccguggaggccggcagaacccugagagugcugaaccugguggagaacuggcugaacaacaacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccagcggcaacaucgugagcagcgugaacaugaucagcagaaugcugaucaacagauucaccaugagacacaagaaggccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacgugcugcccaccgugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcagauucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacauggagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcguguucaagaacauccagcaccugaccgugaccgaggagguggccgugcagaacuggcuggccagagugggcagagagagacugagcagaauggccaucagcggcgacgacugcguggugaagccccuggacgacagauucgccaacgcccugaccgcccugaacgacaugggcaagaucagaaaggacauccagcagugggagcccagcaagggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugagagagaccgccugccugggcaagagcuacgcccagauguggagccugauguacuuccacagaagagaccugagacuggccgccaacgccaucugcagcgccgugcccagccacugggugcccaccagcagaaccaccuggagcauccacgccaagcacgaguggaugaccaccgaggacaugcugaccguguggaacagaguguggaucagagagaaccccuggauggaggacaagacccccguggagagcugggaggagauccccuaccugggcaagagagaggaccaguggugcggcagccugaucggccugaccagcagagccaccugggccaagaacauccaggccgccaucaaccaggugagaagccugaucggcaacgaggaguacaccgacuacaugcccagcaugaagagauucagaagagaggaggaggaggccggcgugcugugguga

SEQ ID NO: 17447 - RNA, 9876 nt, Artificial Sequence
  derived and/or modified CDS sequence (opt4) from DENV-2__FJ461321__SS-prME
agcgccggcaugaucaucaugcugauccccaccgugauggccuuccaccugaccaccagaaacggcgagccccacaugaucgugggcauccaggagaagggcaagagccugcuguucaagaccgaggacggcgugaacaugugcacccugauggccauggaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgcccagagaaucgagaccuggauccugagacaccccggcuucaccaucauggccgccauccuggccuacaccaucggcaccacccacuuccagagagugcugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaaggaggagcaggacaagagauucgugugcaagcacagcaugguggacagaggcuggggcaacggcugcggccuguucggcaagggcggcaucgugaccugcgccauguucaccugcaagaagaacauggagggcaagaucgugcagcccgagaaccuggaguacaccaucguggugaccccccacagcggcgaggagcacagcgugggcaacgacaccggcaagcacggcauggagaucaaggugaccccccagagcagcaucaccgaggccgagcugaccggcuacggcaccgugaccauggagugcagccccagaaccggccuggacuucaacgagauggugcugcugcagauggagaacaaggccuggcuggugcacagacagugguuccuggaccugccccugcccuggcugcccggcgccgacaagcaggagagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucgugaucagagugcaguacgagggcgacggcagccccugcaagauccccuucgagaucauggaccuggagaagagauacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcaucgugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccaggaggagggcaucugcggcaucagaagcgugaccagacuggagaaccugauguggaagcagaucacccccgagcugaaccacauccuggccgagaacgaggugaagcugaccaucaugaccggcgacaucagaggcaucaugcaggccggcaagagaagccugagaccccagcccaccgagcugaaguacagcuggaagaccuggggcaaggccaagaugcugagcaccgagagcuacaaccagaccuuccugaucgacggccccgagaccgccgagugccccaacaccaacagagccuggaacagccuggagguggaggacuacggcuucggcguguucaccaccaacaucuggcugaagcugaaggagaagcaggacgccuucugcgacagcaagcugaugagcgccgccaucaaggacaacagagccgugcacgccgacaugggcuacuggaucgagagcgcccugaacgacaccuggaagaucgagaaggccagcuucaucgaggugaagaacugccacuggcccaagagccacacccuguggagcaacggcgugcuggagagcgagaugaucauccccaagaaccuggccggccccgugagccagcacaacuacagacccggcuaccacacccagaucgccggccccuggcaccugggcaagcuggagauggacuucgacuucugcgacggcaccaccgugaucgugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagguggacaacuucagccugggcgugcugggcauggcccuguuccuggaggagaugcugagaaccagagugggcaccaagcacgccauccugcugguggccgugagcuucgugacccugaucaccggcaacaugagcuucaaggaccugggcagagugguggugauggugggcgccaccauggccgacgacaucggcaugggcgugaccuaccuggcccugcuggccgccuucaaggugagacccaccuucgccgccggccugcugcugagaaagcugaccagcaaggagcugaugaugaccaccaucggcaucgugcugcugagccagagcaccauccccgagaccgugcuggagcugaccgacgcccuggcccugggcaugauggugcugaagaucgugagaaacauggagaaguaccagcuggccgugaccaucauggccauccugugcgugcccaacgccgugauccugcagaacgccuggaaggugagcugcaccauccuggccguggugagcgugagcccccugcugcugaccagcagccagcagaagaccgacuggaucccccuggcccugaccaucaagggccugaaccccaccgccaucuuccugaccacccugagcagaaccaacaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccaccaacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggccuguuccccaucagcauccccaucaccgccgccgccugguaccugugggaggugaagaagcagagagccggcgugcugugggacgugcccagccccccccccaugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacaagggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucaucgacaagaagggcaagguggugggccuguacggcaacggcguggugaccagaagcggcgccuacgugagcgccaucgcccagaccgagaagagcaucgaggacaaccccgagaucgaggacgacaucuucagaaagagaagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucaucgacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagagcgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaagauggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaagaccagagacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcagaggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucgccacccagcagcccgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggaccccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaucccccccgagaagugcgacacccugcugugcgacaucggcgagagcagccccaaccccaccguggaggccggcagaacccugagagugcugaaccugguggagaacuggcugaacaacaacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccagcggcaacaucgugagcagcgugaacaugaucagcagaaugcugaucaacagauucaccaugagacacaagaaggccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacgugcugcccaccgugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcagauucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacauggagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcguguucaagaacauccagcaccugaccgugaccgaggagguggccgugcacaacuggcuggccagagugggcagagagagacugagcagaauggccaucagcggcgacgacugcguggugaagccccuggacgacagauucgccaacgcccugaccgcccugaacgacaugggcaagaucagaaaggacauccagcagugggagcccagcaagggcuggaacgacuggacccaggugcccuucugcagccaccacuuccacgagcugaucaugaaggacggcagaauccugguggugcccugcagaaaccaggacgagcugaucggcagagccagaaucagccagggcgccggcuggagccugagagagaccgccugccugggcaagagcuacgcccagauguggagccugauguacuuccacagaagagaccugagacuggccgccaacgccaucugcagcgccgugcccagccacugggugcccaccagcagaaccaccuggagcauccacgccaagcacgaguggaugaccaccgaggacaugcugaccguguggaacagaguguggaucagagagaaccccuggauggaggacaagacccccguggagagcugggaggagauccccuaccugggcaagagagaggaccaguggugcggcagccugaucggccugaccagcagagccaccugggccaagaacauccaggccgccaucaaccaggugagaagccugaucggcaacgaggaguacaccgacuacaugcccagcaugaagagauucagaagagaggaggaggaggccggcgugcugugguga

SEQ ID NO: 17448 - RNA, 9876 nt, Artificial Sequence
  derived and/or modified CDS sequence (opt4) from DENV-2__FJ410228__SS-prME
agcgccggcaugaucaucaugcugauccccaccgugauggccuuccaccugaccaccagaaacggcgagccccacaugaucgugggcauccaggagaagggcaagagccugcuguucaagaccgaggacggcgugaacaugugcacccugauggccauggaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgcccagagaaucgagaccuggauccugagacaccccggcuucaccaucauggccgccauccuggccuacaccaucggcaccacccacuuccagagagugcugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaaggaggagcaggacaagagauucgugugcaagcacagcaugguggacagaggcuggggcaacggcugcggccuguucggcaagggcggcaucgugaccugcgccauguucaccugcaagaagaacauggagggcaagaucgugcagcccgagaaccuggaguacaccaucguggugaccccccacagcggcgaggagcacgccgugggcaacgacaccggcaagcacggcauggagaucaaggugaccccccagagcagcaucaccgaggccgagcugaccggcuacggcaccgugaccauggagugcagccccagaaccggccuggacuucaacgagauggugcugcugcagauggagaacaaggccuggcuggugcacagacagugguuccuggaccugccccugcccuggcugcccggcgccgacaagcaggagagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucgugaucagagugcaguacgagggcgacggcagccccugcaagauccccuucgagaucauggaccuggagaagagauacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcaucgugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccaggaggagggcaucugcggcaucagaagcgugaccagacuggagaaccugauguggaagcagaucacccccgagcugaaccacauccuggccgagaacgaggugaagcugaccaucaugaccggcgacaucagaggcaucaugcaggccggcaagagaagccugagaccccagcccaccgagcugaaguacagcuggaagaccuggggcaaggccaagaugcugagcaccgagagcuacaaccagaccuuccugaucgacggccccgagaccgccgagugccccaacaccaacagagccuggaacagccuggagguggaggacuacggcuucggcguguucaccaccaacaucuggcugaagcugaaggagaagcaggacgccuucugcgacagcaagcugaugagcgccgccaucaaggacaacagagccgugcacgccgacaugggcuacuggaucgagagcgcccugaacgacaccuggaagaucgagaaggccagcuucaucgaggugaagaacugccacuggcccaagagccacacccuguggagcaacggcgugcuggagagcgagaugaucauccccaagaaccuggccggccccgugagccagcacaacuacagacccggcuaccacacccagaucgccggccccuggcaccugggcaagcuggagauggacuucgacuucugcgacggcaccaccgugaucgugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagguggacaacuucagccugggcgugcugggcauggcccuguuccuggaggagaugcugagaaccagagugggcaccaagcacgccauccugcugguggccgugagcuucgugacccugaucaccggcaacaugagcuucaaggaccugggcagagugguggugauggugggcgccaccauggccgacgacaucggcaugggcgugaccuaccuggcccugcuggccgccuucaaggugagacccaccuucgccgccggccugcugcugagaaagcugaccagcaaggagcugaugaugaccaccaucggcaucgugcugcugagccagagcaccauccccgagaccgugcuggagcugaccgacgcccuggcccugggcaugauggugcugaagaucgugagaaacauggagaaguaccagcuggccgugaccaucauggccauccugugcgugcccaacgccgugauccugcagaacgccuggaaggugagcugcaccauccuggccguggugagcgugagcccccugcugcugaccagcagccagcagaagaccgacuggaucccccuggcccugaccaucaagggccugaaccccaccgccaucuuccugaccacccugagcagaaccaacaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccaccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggccuguuccccaucagcauccccaucaccgccgccgccugguaccugugggaggugaagaagcagagagccggcgugcugugggacgugcccagccccccccccaugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacaagggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucaucgacaagaagggcaagguggugggccuguacggcaacggcguggugaccagaagcggcgccuacgugagcgccaucgcccagaccgagaagagcaucgaggacaaccccgagaucgaggacgacaucuucagaaagagaagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucaucgacgaggagagagagauccccgagagaagcuggaacagcggccacgagugggugaccgacuucaacggcaagaccgugugguucgugcccagcaucaaggccggcaacgacaucgccgccugccugagaaagaacggcaagaaggugauccagcugagcagaaagaccuucgacagcgaguacgugaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaagauggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaagaccagagacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcagaggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucgccacccagcagcccgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggaccccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaucccccccgagaagugcgacacccugcugugcgacaucggcgagagcagccccaaccccaccguggaggccggcagaacccugagagugcugaaccugguggagaacuggcugaacaacaacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccagcggcaacaucgugagcagcgugaacaugaucagcagaaugcugaucaacagauucaccaugagacacaagaaggccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacgugcugcccaccgugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcagauucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacauggagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcguguucaagaacauccagcaccugaccgugaccgaggagguggccgugcacaacuggcuggccagagugggcagagagagacugagcagaauggccaucagcggcgacgacugcguggugaagccccuggacgacagauucgccaacgcccugaccgcccugaacgacaugggcaagaucagaaaggacauccagcagugggagcccagcaagggcuggaacgacuggacccaggugcccuucugcagccaccacuuccacgagcugaucaugaaggacggcagaauccugguggugcccugcagaaaccaggacgagcugaucggcagagccagaaucagccagggcgccggcuggagccugagagagaccgccugccugggcaagagcuacgcccagauguggagccugauguacuuccacagaagagaccugagacuggccgccaacgccaucugcagcgccgugcccagccacugggugcccaccagcagaaccaccuggagcauccacgccaagcacgaguggaugaccaccgaggacaugcugaccguguggaacagaguguggaucagagagaaccccuggauggaggacaagacccccguggagagcugggaggagauccccuaccugggcaagagagaggaccaguggugcggcagccugaucggccugaccagcagagccaccugggccaagaacauccaggccgccaucaaccaggugagaagccugaucggcaacgaggaguacaccgacuacaugcccagcaugaagagauucagaagagaggaggaggaggccggcgugcugugguga

SEQ ID NO: 17449 - RNA, 9876 nt, Artificial Sequence
  derived and/or modified CDS sequence (opt4) from DENV-2__FJ410233__SS-prME
agcgccggcaugaucaucaugcugauccccaccgugauggccuuccaccugaccaccagaaacggcgagccccacaugaucgugggcauccaggagaagggcaagagccugcuguucaagaccgaggacggcgugaacaugugcacccugauggccauggaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgcccagagaaucgagaccuggauccugagacaccccggcuucaccaucauggccgccauccuggccuacaccaucggcaccacccacuuccagagagugcugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaaggaggagcaggacaagagauucgugugcaagcacagcaugguggacagaggcuggggcaacggcugcggccuguucggcaagggcggcaucgugaccugcgccauguucaccugcaagaagaacauggagggcaagaucgugcagcccgagaaccuggaguacaccaucguggugaccccccacagcggcgaggagcacgccgugggcaacgacaccggcaagcacggccaggagaucaaggugaccccccagagcagcaucaccgaggccgagcugaccggcuacggcaccgugaccauggagugcagccccagaaccggccuggacuucaacgagauggugcugcugcagauggagaacaaggccuggcuggugcacagacagugguuccuggaccugccccugcccuggcugcccggcgccgacaagcaggagagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucgugaucagagugcaguacgagggcgacggcagccccugcaagauccccuucgagaucauggaccuggagaagagauacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcaucgugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccaggaggagggcaucugcggcaucagaagcgugaccagacuggagaaccugauguggaagcagaucacccccgagcugaaccacauccuggccgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagcuacaaccagaccuuccugaucgacggccccgagaccgccgagugccccaacaccaacagagccuggaacagccuggagguggaggacuacggcuucggcguguucaccaccaacaucuggcugaagcugaaggagaagcaggacgccuucugcgacagcaagcugaugagcgccgccaucaaggacaacagagccgugcacgccgacaugggcuacuggaucgagagcgcccugaacgacaccuggaagaucgagaaggccagcuucaucgaggugaagaacugccacuggcccaagagccacacccuguggagcaacggcgugcuggagagcgagaugaucauccccaagaaccuggccggccccgugagccagcacaacuacagacccggcuaccacacccagaucgccggccccuggcaccugggcaagcuggagauggacuucaacuucugcgacggcaccaccgugaucgugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagguggacaacuucagccugggcgugcugggcauggcccuguuccuggaggagaugcugagaaccagagugggcaccaagcacgccauccugcugguggccgugagcuucgugacccugaucaccggcaacaugagcuucaaggaccugggcagagugguggugauggugggcgccaccaugaccgacgacaucggcaugggcgugaccuaccuggcccugcuggccgccuucaaggugagacccaccuucgccgccggccugcugcugagaaagcugaccagcaaggagcugaugaugaccaccaucggcaucgugcugcugagccagagcaccauccccgagaccgugcuggagcugaccgacgcccuggcccugggcaugauggugcugaagaucgugagaaacauggagaaguaccagcuggccgugaccaucauggccauccugugcgugcccaacgccgugauccugcagaacgccuggaaggugagcugcaccauccuggccguggugagcgugagcccccugcugcugaccagcagccagcagaagaccgacuggaucccccuggcccugaccaucaagggccugaaccccaccgccaucuuccugaccacccugagcagaaccaacaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccaccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggccuguuccccaucagcauccccaucaccgccgccgccugguaccugugggaggugaagaagcagagagccggcgugcugugggacgugcccagccccccccccaugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacaagggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucaucgacaagaagggcaagguggugggccuguacggcaacggcguggugaccagaagcggcgccuacgugagcgccaucgcccagaccgagaagagcaucgaggacaaccccgagaucgaggacgacaucuucagaaagagaagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucaucgacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaagauggugcuucgacggcaucaagaacaaccagauccuggaggagaacauggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaagaccagagacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcagaggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucgccaccagacagcccgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggaccccauccccuacgaccccaaguucgagaagcagcugggccaggugaugcugcuggugcugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaugggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaucccccccgagaagugcgacacccugcugugcgacaucggcgagagcagccccaaccccaccguggaggccggcagaacccugagagugcugaaccugguggagaacuggcugaacaacaacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccagcggcaacaucgugagcagcgugaacaugaucagcagaaugcugaucaacagauucaccaugagacacaagaaggccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacgugcugcccaccgugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcagauucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacauggagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcguguucaagaacauccagcaccugaccgugaccgaggagguggccgugaagaacuggcuggccagagugggcagagagagacugagcagaauggccaucagcggcgacgacugcguggugaagccccuggacgacagauucgccaacgcccugaccgcccugaacgacaugggcaagaucagaaaggacauccagcagugggagcccagcaagggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugagagagaccgccugccugggcaagagcuacgcccagauguggagccugauguacuuccacagaagagaccugagacuggccgccaacgccaucugcagcgccgugcccagccacugggugcccaccagcagaaccaccuggagcauccacgccaagcacgaguggaugaccaccgaggacaugcugaccguguggaacagaguguggaucagagagaaccccuggauggaggacaagacccccguggagagcugggaggagauccccuaccugggcaagagagaggaccaguggugcggcagccugaucggccugaccagcagagccaccugggccaagaacauccaggccgccaucaaccaggugagaagccugaucggcaacgaggaguacaccgacuacaugcccagcaugaagagauucagaagagaggaggaggaggccggcgugcugugguga

SEQ ID NO: 17450 - RNA, 9876 nt, Artificial Sequence
  derived and/or modified CDS sequence (opt4) from DENV-2__FJ410237__SS-prME
agcgccggcaugaucaucaugcugauccccaccgugauggccuuccaccugaccaccagaaacggcgagccccacaugaucgugggcauccaggagaagggcaagagccugcuguucaagaccgaggacggcgugaacaugugcacccugauggccauggaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgcccagagaaucgagaccuggauccugagacaccccggcuucaccaucauggccgccauccuggccuacaccaucggcaccacccacuuccagagagugcugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaaggaggagcaggacaagagauucgugugcaagcacagcaugguggacagaggcuggggcaacggcugcggccuguucggcaagggcggcaucgugaccugcgccauguucaccugcaagaagaacauggagggcaagaucgugcagcccgagaaccuggaguacaccaucguggugaccccccacagcggcgaggagcacgccgugggcaacgacaccggcaagcacggccaggagaucaaggugaccccccagagcagcaucaccgaggccgagcugaccggcuacggcaccgugaccauggagugcagccccagaaccggccuggacuucaacgagauggugcugcugcagauggagaacaaggccuggcuggugcacagacagugguuccuggaccugccccugcccuggcugcccggcgccgacaagcaggagagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucgugaucagagugcaguacgagggcgacggcagccccugcaagauccccuucgagaucauggaccuggagaagagauacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcaucgugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccaggaggagggcaucugcggcaucagaagcgugaccagacuggagaaccugauguggaagcagaucacccccgagcugaaccacauccuggccgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagcuacaaccagaccuuccugaucgacggccccgagaccgccgagugccccaacaccaacagagccuggaacagccuggagguggaggacuacggcuucggcguguucaccaccaacaucuggcugaagcugaaggagaagcaggacgccuucugcgacagcaagcugaugagcgccgccaucaaggacaacagagccgugcacgccgacaugggcuacuggaucgagagcgcccugaacgacaccuggaagaucgagaaggccagcuucaucgaggugaagaacugccacuggcccaagagccacacccuguggagcaacggcgugcuggagagcgagaugaucauccccaagaaccuggccggccccgugagccagcacaacuacagacccggcuaccacacccagaucgccggccccuggcaccugggcaagcuggagauggacuucgacuucugcgacggcaccaccgugaucgugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagguggacaacuucagccugggcgugcugggcauggcccuguuccuggaggagaugcugagaaccagagugggcaccaagcacgccauccugcugguggccgugagcuucgugacccugaucaccggcaacaugagcuucaaggaccugggcagagugguggugauggugggcgccaccaugaccgacgacaucggcaugggcgugaccuaccuggcccugcuggccgccuucaaggugagacccaccuucgccgccggccugcugcugagaaagcugaccagcaaggagcugaugaugaccaccaucggcaucgugcugcugagccagagcaccauccccgagaccgugcuggagcugaccgacgcccuggcccugggcaugauggugcugaagaucgugagaaacauggagaaguaccagcuggccgugaccaucauggccauccugugcgugcccaacgccgugauccugcagaacgccuggaaggugagcugcaccauccuggccguggugagcgugagcccccugcugcugaccagcagccagcagaagaccgacuggaucccccuggcccugaccaucaagggccugaaccccaccgccaucuuccugaccacccugagcagaaccaacaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccaccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggccuguuccccaucagcauccccaucaccgccgccgccugguaccugugggaggugaagaagcagagagccggcgugcugugggacgugcccagccccccccccaugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacaagggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucaucgacaagaagggcaagguggugggccuguacggcaacggcguggugaccagaagcggcgccuacgugagcgccaucgcccagaccgagaagagcaucgaggacaaccccgagaucgaggacgacaucuucagaaagagaagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucaucgacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaagauggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaagaccagagacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcagaggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucgccacccagcagcccgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggaccccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaugggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaucccccccgagaagugcgacacccugcugugcgacaucggcgagagcagccccaaccccaccguggaggccggcagaacccugagagugcugaaccugguggagaacuggcugaacaacaacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccagcggcaacaucgugagcagcgugaacaugaucagcagaaugcugaucaacagauucaccaugagacacaagaaggccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacgugcugcccaccgugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcagauucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacauggagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcguguucaagaacauccagcaccugaccgugaccgaggagguggccgugaagaacuggcuggccagagugggcagagagagacugagcagaauggccaucagcggcgacgacugcguggugaagccccuggacgacagauucgccaacgcccugaccgcccugaacgacaugggcaagaucagaaaggacauccagcagugggagcccagcaagggcuggaucgacuggacccaggugcccuucugcagccaccacuuccacgagcugaucaugaaggacggcagagugcugguggugcccugcagaaaccaggacgagcugaucggcagagccagaaucagccagggcgccggcuggagccugagagagaccgccugccugggcaagagcuacgcccagauguggagccugauguacuuccacagaagagaccugagacuggccgccaacgccaucugcagcgccgugcccagccacugggugcccaccagcagaaccaccuggagcauccacgccaagcacgaguggaugaccaccgaggacaugcugaccguguggaacagaguguggaucagagagaaccccuggauggaggacaagacccccguggagagcugggaggagauccccuaccugggcaagagagaggaccaguggugcggcagccugaucggccugaccagcagagccaccugggccaagaacauccaggccgccaucaaccaggugagaagccugaucggcaacgaggaguacgccgacuacaugcccagcaugaagagauucagaagagaggaggaggaggccggcgugcugugguga

SEQ ID NO: 17451 - RNA, 9876 nt, Artificial Sequence
  derived and/or modified CDS sequence (opt4) from DENV-2__FJ410241__SS-prME
agcgccggcaugaucaucaugcugauccccaccgugauggccuuccaccugaccaccagaaacggcgagccccacaugaucgugggcauccaggagaagggcaagagccugcuguucaagaccgaggacggcgugaacaugugcacccugauggccauggaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgcccagagaaucgagaccuggauccugagacaccccggcuucaccaucauggccgccauccuggccuacaccaucggcaccacccacuuccagagagugcugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaaggaggagcaggacaagagauucgugugcaagcacagcaugguggacagaggcuggggcaacggcugcggccuguucggcaagggcggcaucgugaccugcgccauguucaccugcaagaagaacauggagggcaagaucgugcagcccgagaaccuggaguacaccaucguggugaccccccacagcggcgaggagcacgccgugggcaacgacaccggcaagcacggccaggagaucaaggugaccccccagagcagcaucaccgaggccgagcugaccggcuacggcaccgugaccauggagugcagccccagaaccggccuggacuucaacgagauggugcugcugcagauggagaacaaggccuggcuggugcacagacagugguuccuggaccugccccugcccuggcugcccggcgccgacaagcaggagagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucgugaucagagugcaguacgagggcgacggcagccccugcaagauccccuucgagaucauggaccuggagaagagauacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcaucgugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccaggaggagggcaucugcggcaucagaagcgugaccagacuggagaaccugauguggaagcagaucacccccgagcugaaccacauccuggccgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagcuacaaccagaccuuccugaucgacggccccgagaccgccgagugccccaacaccaacagagccuggaacagccuggagguggaggacuacggcuucggcguguucaccaccaacaucuggcugaagcugaaggagaagcaggacgccuucugcgacagcaagcugaugagcgccgccaucaaggacaacagagccgugcacgccgacaugggcuacuggaucgagagcgcccugaacgacaccuggaagaucgagaaggccagcuucaucgaggugaagaacugccacuggcccaagagccacacccuguggagcaacggcgugcuggagagcgagaugaucauccccaagaaccuggccggccccgugagccagcacaacuacagacccggcuaccacacccagaucgccggccccuggcaccugggcaagcuggagauggacuucgacuucugcgacggcaccaccgugaucgugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagguggacaacuucagccugggcgugcugggcauggcccuguuccuggaggagaugcugaagaccagagugggcaccaagcacgccauccugcugguggccgugagcuucgugacccugaucaccggcaacaugagcuucaaggaccugggcagagugguggugauggugggcgccaccauggccgacgacaucggcaugggcgugaccuaccuggcccugcuggccgccuucaaggugagacccaccuucgccgccggccugcugcugagaaagcugaccagcaaggagcugaugaugaccaccaucggcaucgugcugcugagccagagcaccauccccgagaccgugcuggagcugaccgacgcccuggcccugggcaugauggugcugagaaucgugagaaacauggagaaguaccagcuggccgugaccaucauggccauccugugcgugcccaacgccgugauccugcagaacgccuggaaggugagcugcaccauccuggccguggugagcgugagcccccugcugcugaccagcagccagcagaagaccgacuggaucccccuggcccugaccaucaagggccugaaccccaccgccaucuuccugaccacccugagcagaaccaacaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccaccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggccuguuccccaucagcauccccaucaccgccgccgccugguaccugugggaggugaagaagcagagagccggcgugcugugggacgugcccagccccccccccaugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacaagggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucaucgacaagaagggcaagguggugggccuguacggcaacggcguggugaccagaagcggcgccuacgugagcgccaucgcccagaccgagaagagcaucgaggacaaccccgagaucgaggacgacaucuucagaaagagaagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucaucgacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaagauggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaagaccagagacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcagaggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucgccacccagcagcuggagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggaccccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaugggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaucccccccgagaagugcgacacccugcugugcgacaucggcgagagcagccccaaccccaccguggaggccggcagaacccugagagugcugaaccugguggagaacuggcugaacaacaacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccagcggcaacaucgugagcagcgugaacaugaucagcagaaugcugaucaacagauucaccaugagacacaagaaggccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacgugcugcccaccgugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcagauucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacauggagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcguguucaagaacauccagcaccugaccgugaccgaggagguggccgugcagaacuggcuggccagagugggcagagagagacugagcagaauggccaucagcggcgacgacugcguggugaagccccuggacgacagauucgccaacgcccugaccgcccugaacgacaugggcaagaucagaaaggacauccagcagugggagcccagcaagggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugagagagaccgccugccugggcaagagcuacgcccagauguggagccugauguacuuccacagaagagaccugagacuggccgccaacgccaucugcagcgccgugcccagccacugggugcccaccagcagaaccaccuggagcauccacgccaagcacgaguggaugaccaccgaggacaugcugaccguguggaacagaguguggaucagagagaaccccuggauggaggacaagacccccguggagagcugggaggagauccccuaccugggcaagagagaggaccaguggugcggcagccugaucggccugaccagcagagccaccugggccaagaacauccaggccgccaucaaccaggugagaagccugaucggcaacgaggaguacaccgacuacaugcccagcaugaagagauucagaagagaggaggaggaggccggcgugcugugguga

SEQ ID NO: 17452 - RNA, 9876 nt, Artificial Sequence
  derived and/or modified CDS sequence (opt4) from DENV-2__FJ410259__SS-prME
agcgccggcaugaucaucaugcugauccccaccgugauggccuuccaccugaccaccagaaacggcgagccccacaugaucgugggcauccaggagaagggcaagagccugcuguucaagaccgaggacggcgugaacaugugcacccugauggccauggaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgcccagagaaucgagaccuggauccugagacaccccggcuucaccaucauggccgccauccuggccuacaccaucggcaccacccacuuccagagagugcugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaaggaggagcaggacaagagauucgugugcaagcacagcaugguggacagaggcuggggcaacggcugcggccuguucggcaagggcggcaucgugaccugcgccauguucaccugcaagaagaacauggagggcaagaucgugcagcccgagaaccuggaguacaccaucguggugaccccccacagcggcgaggagcacgccgugggcaacgacaccggcaagcacggcauggagaucaaggugaccccccagagcagcaccaccgaggccgagcugaccggcuacggcaccgugaccauggagugcagccccagaaccggccuggacuucaacgagauggugcugcugcagauggagaacaaggccuggcuggugcacagacagugguuccuggaccugccccugcccuggcugcccggcgccgacaagcaggagagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucgugaucagagugcaguacgagggcgacggcagccccugcaagauccccuucgagaucauggaccuggagaagagauacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcaucgugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccaggaggagggcaucugcggcaucagaagcgugaccagacuggagaaccugauguggaagcagaucacccccgagcugaaccacauccuggccgagaacgaggugaagcugaccaucaugaccggcgacaucagaggcaucaugcaggccggcaagagaagccugagaccccagcccaccgagcugaaguacagcuggaagaccuggggcaaggccaagaugcugagcaccgagagcuacaaccagaccuuccugaucgacggccccgagaccgccgagugccccaacaccaacagagccuggaacagccuggagguggaggacuacggcuucggcguguucaccaccaacaucuggcugaagcugaaggagaagcaggacgccuucugcgacagcaagcugaugagcgccgccaucaaggacaacagagccgugcacgccgacaugggcuacuggaucgagagcgcccugaacgacaccuggaagaucgagaaggccagcuucaucgaggugaagaacugccacuggcccaagagccacacccuguggagcaacggcgugcuggagagcgagaugaucauccccaagaaccuggccggccccgugagccagcacaacuacagacccggcuaccacacccagaucgccggccccuggcaccugggcaagcuggagauggacuucgacuucugcgacggcaccaccgugaucgugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagguggacaacuucagccugggcgugcugggcauggcccuguuccuggaggagaugcugagaaccagagugggcaccaagcacgccauccugcuggccgccgugagcuucgugacccugaucaccggcaacaugagcuucaaggaccugggcagagugguggugauggugggcgccaccauggccgacgacaucggcaugggcgugaccuaccuggcccugcuggccgccuucaaggugagacccaccuucgccgccggccugcugcugagaaagcugaccagcaaggagcugaugaugaccaccaucggcaucgugcugcugagccagagcaccauccccgagaccgugcuggagcugaccgacgcccuggcccugggcaugauggugcugaagaucgugagaaacauggagaaguaccagcuggccgugaccaucauggccauccugugcgugcccaacgccgugauccugcagaacgccuggaaggugagcugcaccauccuggccguggugagcgugagcccccugcugcugaccagcagccagcagaagaccgacuggaucccccuggcccugaccaucaagggccugaaccccaccgccaucuuccugaccacccugagcagaaccaacaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccaccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggccuguuccccaucagcauccccaucaccgccgccgccugguaccugugggaggugaagaagcagagagccggcgugcugugggacgugcccagccccccccccaugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacaagggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucaucgacaagaagggcaagguggugggccuguacggcaacggcguggugaccagaagcggcgccuacgugagcgccaucgcccagaccgagaagagcaucgaggacaaccccgagaucgaggacgacaucuucagaaagagaagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucaucgacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaagauggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaagaccagagacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcagaggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucgccacccagcagcccgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggaccccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaucccccccgagaagugcgacacccugcugugcgacaucggcgagagcagccccaaccccaccguggaggccggcagaacccugagagugcugaaccugguggagaacuggcugaacaacaacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccagcggcaacaucgugagcagcgugaacaugaucagcagaaugcugaucaacagauucaccaugagacacaagaaggccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacgugcugcccaccgugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcagauucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacauggagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcguguucaagaacauccagcaccugaccgugaccgaggagguggccgugcacaacuggcuggccagagugggcagagagagacugagcagaauggccaucagcggcgacgacugcguggugaagccccuggacgacagauucgccaacgcccugaccgcccugaacgacaugggcaagaucagaaaggacauccagcagugggagcccagcaagggcuggaacgacuggacccaggugcccuucugcagccaccacuuccacgagcugaucaugaaggacggcagaauccugguggugcccugcagaaaccaggacgagcugaucggcagagccagaaucagccagggcgccggcuggagccugagagagaccgccugccugggcaagagcuacgcccagauguggagccugauguacuuccacagaagagaccugagacuggccgccaacgccaucugcagcgccgugcccagccacugggugcccaccagcagaaccaccuggagcauccacgccaagcacgaguggaugaccaccgaggacaugcugaccguguggaacagaguguggaucagagagaaccccuggauggaggacaagacccccguggagagcugggaggagauccccuaccugggcaagagagaggaccaguggugcggcagccugaucggccugaccagcagagccaccugggccaagaacauccaggccgccaucaaccaggugagaagccugaucggcaacgaggaguacaccgacuacaugcccagcaugaagagauucagaagagaggaggaggaggccggcgugcugugguga

SEQ ID NO: 17453 - RNA, 9876 nt, Artificial Sequence
  derived and/or modified CDS sequence (opt4) from DENV-2__FJ547067__SS-prME
agcgccggcaugaucaucaugcugauccccaccgugauggccuuccaccugaccaccagaaacggcgagccccacaugaucgugggcauccaggagaagggcaagagccugcuguucaagaccgaggacggcgugaacaugugcacccugauggccauggaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgcccagagaaucgagaccuggauccugagacaccccggcuucaccaucauggccgccauccuggccuacaccaucggcaccacccacuuccagagagugcugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaaggaggagcaggacaagagauucgugugcaagcacagcaugguggacagaggcuggggcaacggcugcggccuguucggcaagggcggcaucgugaccugcgccauguucaccugcaagaagaacauggagggcaagaucgugcagcccgagaaccuggaguacaccaucguggugaccccccacagcggcgaggagcacgccgugggcaacgacaccggcaagcacggccaggagaucaaggugaccccccagagcagcaucaccgaggccgagcugaccggcuacggcaccgugaccauggagugcagccccagaaccggccuggacuucaacgagauggugcugcugcagauggagaacaaggccuggcuggugcacagacagugguuccuggaccugccccugcccuggcugcccggcgccgacaagcaggagagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucgugaucagagugcaguacgagggcgacggcagccccugcaagauccccuucgagaucauggaccuggagaagagauacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcaucgugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccaggaggagggcaucugcggcaucagaagcgugaccagacuggagaaccugauguggaagcagaucacccccgagcugaaccacauccuggccgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagcuacaaccagaccuuccugaucgacggccccgagaccgccgagugccccaacaccaacagagccuggaacagccuggagguggaggacuacggcuucggcguguucaccaccaacaucuggcugaagcugaaggagaagcaggacgccuucugcgacagcaagcugaugagcgccgccaucaaggacaacagagccgugcacgccgacaugggcuacuggaucgagagcgcccugaacgacaccuggaagaucgagaaggccagcuucaucgaggugaagaacugccacuggcccaagagccacacccuguggagcaacggcgugcuggagagcgagaugaucauccccaagaaccuggccggccccgugagccagcacaacuacagacccggcuaccacacccagaucgccggccccuggcaccugggcaagcuggagauggacuucgacuucugcgacggcaccaccgugaucgugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagguggacaacuucagccugggcgugcugggcauggcccuguuccuggaggagaugcugagaaccagagugggcaccaagcacgccauccugcugguggccaucagcuucgugacccugaucaccggcaacaugagcuucaaggaccugggcagagugguggugauggugggcgccaccauggccgacgacaucggcaugggcgugaccuaccuggcccugcuggccgccuucaaggugagacccaccuucgccgccggccugcugcugagaaagcugaccagcaaggagcugaugaugaccaccaucggcaucgugcugcugagccagagcaccauccccgagaccgugcuggagcugaccgacgcccuggcccugggcaugauggugcugaagaucgugagaaacauggagaaguaccagcuggccgugaccaucauggccauccugugcgugcccaacgccgugauccugcagaacgccuggaaggugagcugcaccauccuggccgccgugagcgugagcccccugcugcugaccagcagccagcagaagaccgacuggaucccccuggcccugaccaucaagggccugaaccccaccgccaucuuccugaccacccugagcagaaccaacaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccaccgacgugaagugggaggagcaggccgagaucagcggcagcagccccauccugagcaucaccaucagcgaggacggcagcaugagcaucaagaacgaggaggaggagcagacccugaccauccugaucagaaccggccugcuggugaucagcggccuguuccccaucagcauccccaucaccgccgccgccugguaccugugggaggugaagaagcagagagccggcgugcugugggacgugcccagccccccccccaugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacaagggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucaucgacaagaagggcaagguggugggccuguacggcaacggcguggugaccagaagcggcgccuacgugagcgccaucgcccagaccgagaagagcaucgaggacaaccccgagaucgaggacgacaucuucagaaagagaagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucaucgacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaagauggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaagaccagagacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcagaggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucgccacccagcagcccgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggaccccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaugggcgagacccugggcgagaaguggaagagcagacugaacgcccugggcaagagcgaguuccagguguacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaucccccccgagaagugcgacacccugcugugcgacaucggcgagagcagccccaaccccaccguggaggccggcagaacccugagagugcugaaccugguggagaacuggcugaacaacaacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccagcggcaacaucgugagcagcgugaacaugaucagcagaaugcugaucaacagauucaccaugagacacaagaaggccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacgugcugcccaccgugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcagaaagaagacccccagaaugugcaccagagaggaguucaccagaaaggugagaagcaacgccgcccugggcgccaucuucaccgacgagaacaaguggaagagcgccagagaggccguggaggacagcagauucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacauggagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcguguucaagagcauccagcaccugaccgugaccgaggagguggccgugcagaacuggcuggccagagugggcagagagagacugagcagaauggccaucagcggcgacgacugcguggugaagccccuggacgacagauucgccaacgcccugaccgcccugaacgacaugggcaagaucagaaaggacauccagcagugggagcccagcaagggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugagagagaccgccugccugggcaagagcuacgcccagauguggagccugauguacuuccacagaagagaccugagacuggccgccaacgccaucugcagcgccgugcccagccacugggugcccaccagcagaaccaccuggagcauccacgccaagcacgaguggaugaccaccgaggacaugcugaccguguggaacagaguguggaucagagagaaccccuggauggaggacaagacccccguggagagcugggaggagauccccuaccugggcaagagagaggaccaguggugcggcagccugaucggccugaccagcagagccaccugggccaagaacauccaggccgccaucaaccaggugagaagccugaucggcaacgaggaguacaccgacuacaugcccagcaugaagagauucagaagagaggaggaggaggccggcgugcugugguga

SEQ ID NO: 17454 - RNA, 9876 nt, Artificial Sequence
  derived and/or modified CDS sequence (opt4) from DENV-2__JN819418__SS-prME
accgccggcgugaucaucaugcugauccccaccgccauggccuuccaccugaccaccagaaacggcgagccccacaugaucgugggcagacaggagaagggcaagagccugcuguucaagaccgaggacggcgugaacaugugcacccugauggccaucgaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgugcagagaaucgagaccuggauccugagacaccccggcuucaccaucauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaacgaggagcaggacaagagauucgugugcaagcacagcaugguggacagaggcuggggcaacggcugcggccuguucggcaagggcggcaucgugaccugcgccauguucaccugcaagaagaacauggagggcaagguggugcugcccgagaaccuggaguacaccaucgugaucaccccccacagcggcgaggagcacgccgugggcaacgacaccggcaagcacggcaaggagaucaagaucaccccccagagcagcaucaccgaggccgagcugaccggcuacggcaccgugaccauggagugcagccccagaaccggccuggacuucaacgagauggugcugcugcagauggaggacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagaucgugaaggagaucgccgagacccagcacggcaccaucgugaucagagugcaguacgagggcgacggcagccccugcaagauccccuucgagaucauggaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcguggugacccuguaccugggcgccauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucagcaccaacaucuggcugaagcugagagagaagcaggacguguucugcgacagcaagcugaugagcgccgccaucaaggacaacagagccgugcacgccgacaugggcuacuggaucgagagcgcccugaacgacaccuggaagauggagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcaagcuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugguggccgugagcuucaugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugauggccaccaucggcaucgcccugcugagccagagcaccauccccgagaccauccuggagcugaccgacgcccuggcccugggcaugauggugcugaagaucgugagaaacauggagaaguaccagcuggccgugaccaucauggccaucagcugcgugcccaacgccgugauccugcagaacgccuggaaggugagcugcaccauccuggccgccgugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggccuguuccccgugagcauccccaucaccgccgccgccugguaccugugggaggugaagaagcagagagccggcgugcugugggacgugcccagccccccccccgugggcaaggccgagcuggaggacggcgccuacagaaucaagcagagaggcauccugggcuacagccagaucggcgccggcguguacaaggagggcaccuuccacaccauguggcacgugaccagaggcgccgugcugaugcacagaggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucguggacagaaagggcaagguggugggccuguacggcaacggcguggugaccagaagcggcgccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagagccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacagaguggccgccgagggcaucaacuacgccgacagaagauggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagagacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucaccacccaggagagcgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggaccccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccaucgaggccggcagaacccugagagugcugaaccugguggagaacuggcugaacaacaacacccaguucugcaucaaggugcugaaccccuacaugcccagcgugaucgagaagauggagacccugcagagaaaguacggcggcgcccuggugagaaacccccugagcagaaacagcacccacgagauguacugggugagcaacgccaccggcaacaucgugagcagcgugaacaugaucagcagaaugcugaucaacagauucaccaugaagcacaagaaggccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacguggugcccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacggcagauucugggagcugguggacagagagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacauggagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcaucuucaagagcauccagcaccugaccgugaccgaggagaucgccgugcagaacuggcuggccagagugggcagagagagacugagcagaauggccaucagcggcgacgacugcguggugaagccccuggacgacagauucgccagcgcccugaccgcccugaacgacaugggcaaggugagaaaggacauccagcagugggagcccagcagaggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugaaggagaccgccugccugggcaagagcuacgcccagauguggacccugauguacuuccacagaagagaccugagacuggccgccaacgccaucugcagcgccgugcccagccacugggugcccaccagcagaaccaccuggagcauccacgccaagcacgaguggaugaccaccgaggacaugcuggccguguggaacagaguguggauccaggagaaccccuggauggaggacaagacccccguggagagcugggaggaggugcccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 17455 - RNA, 9876 nt, Artificial Sequence
  derived and/or modified CDS sequence (opt4) from DENV-2__EU482640__SS-prME
accgccggcaucaucaucaugaugauccccaccgugauggccuuccaccugaccaccagaaacggcgagccccacaugaucgugagcagacaggagaagggcaagagccugcuguucaagaccgagaacggcgugaacaugugcacccugauggccauggaccugggcgagcugugcgaggacaccaucaccuacaacugcccccugcugagacagaacgagcccgaggacaucgacugcuggugcaacagcaccagcaccugggugaccuacggcaccugcaccgccaccggcgagcacagaagagagaagagaagcguggcccuggugccccacgugggcaugggccuggagaccagaaccgagaccuggaugagcagcgagggcgccuggaagcacgcccagagaaucgagaccugggugcugagacaccccggcuucaccaucauggccgccauccuggccuacaccaucggcaccaccuacuuccagagagugcugaucuucauccugcugaccaccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcaccccgccacccugagaaaguacugcaucgaggccaagcugaccaacaccaccaccgccagcagaugccccacccagggcgagcccagccugaacgaggagcaggacaagagauucgugugcaagcacagcaugguggacagaggcuggggcaacggcugcggccuguucggcaagggcggcaucgugaccugcgccauguucaccugcaagaagaacauggagggcaagaucgugcagcccgagaaccuggaguacaccaucgugaucaccccccacagcggcgaggagaacgccgugggcaacgacaccggcaagcacggcaaggagaucaaggugaccccccagagcagcaucaccgaggccgagcugaccggcuacggcaccgugaccauggagugcagccccagaaccggccuggacuucaacgagauggugcugcugcagauggagaacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucgugaucagagugcaguacgagggcgacggcagccccugcaagauccccuucgagaucauggaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugagcugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcguggugaucaccuggaucggcaugaacagcagaagcaccagccugagcgugagccuggugcuggugggcguggugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggagacagaucacccccgagcugaaccacauccugagcgagaacgaggugaagcugaccaucaugaccggcgacaucaagggcaucaugcaggccggcaagagaagccugagaccccagcccaccgagcugaaguacagcuggaaggccuggggcaaggccaagaugcugagcaccgagcugcacaaccacaccuuccugaucgacggccccgagaccgccgagugccccaacaccaacagagccuggaacagccuggagguggaggacuacggcuucggcguguucaccaccaacaucuggcugaagcugaaggagagacaggacguguucugcgacagcaagcugaugagcgccgccaucaaggacagcagagccgugcacgccgacaugggcuacuggaucgagagcgcccugaacgacaccuggaagaucgagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcagacuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagaaucggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugaugaccaccaucggcaucgugcugcugagccagagcaccgugcccgagaccauccuggagcugaccgacgcccuggcccugggcaugauggugcugaagaucgugagaaacauggagaaguaccagcuggccgugaccaucauggccauccugugcgugcccaacgccgugauccugcagaacgccuggaaggugagcugcaccacccuggccguggugagcgugagcccccugcugcugaccagcagcagacagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugagaugggaggagcaggccgagaucagcggcagcagccccauccugagcaucaccaucagcgaggacggcagcaugagcaucaagaacgaggaggaggagcagacccugaccauccugaucagaaccggccugcuggugaucagcggccuguuccccgugagcauccccaucaccgccgccgccugguaccugugggaggugaagaagcagagagccggcgugcugugggacgugcccagccccccccccgugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacaagggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucguggacaagaagggcaagguggugggccuguacggcaacggcguggugaccagaagcggcaccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccaucagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacaucaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagagugggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacagaguggccgccgagggcaucaacuacgccgacagaagauggugcuucgacggcgugaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagaaacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggacuucggccugggcagcaucaccacccagcagcccgagagcaacauccuggacaucgaccugagacccgccagcgccuggacccuguacgccguggccaccaccuucaucacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggaccccauccccuacgaccccaaguucgagaagcagcugggccaggugaugcugcuggugcugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccgccaacaccagaagaggcaccggcaacaccggcgagacccugggcgagaaguggaagaacagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaaccuggugacccccgagggcaaggugguggaccugggcugcggcagaggcggcuggagcuacuacugcggcggccugaagaacgugaaggaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccguggaggccggcagaacccugagagugcugaaccugguggagaacuggcugaacaacaacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccagcggcaacaucgugagcagcgugaacaugaucagcagaaugcugaucaacagauucaccaugagacacaagaaggccaccuacgagcccgacguggaccugggcagcggcaccagaaacaucggcaucgagagcgagacccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacgugauccccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcggcuucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacauggagggcgagcacaagaagcuggccgaggccaucuucaagcugaccuaccagaacaagguggugagagugcagagacccacccccagaggcaccgugauggacaucaucagcagaagagaccagagaggcagcggccagguggugaccuacggccugaacaccuucaccaacauggaggcccagcugaucagacagauggagggcgagggcguguucaagagcauccagcagcugaccgugaccgaggagaucgccgugaagaacuggcuggccagagugggcagagagagacugagcagaauggccaucagcggcgacgacugcguggugaagccccuggacgacagauucgccagcgcccugaccgcccugaacgacaugggcaaggugagaaaggacauccagcagugggagcccagcagaggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagcaugagagagaccgccugccugggcaagagcuacgcccagauguggagccugauguacuuccacagaagagaccugagacuggccgccaacgccaucugcagcgccgugcccagccacugggugcccaccagcagaaccaccuggagcauccacgccacccacgaguggaugaccaccgaggacaugcugaccguguggaacagaguguggauccaggagaaccccuggauggaggacaagacccccguggagagcugggaggagauccccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 17456 - RNA, 9876 nt, Artificial Sequence
  derived and/or modified CDS sequence (opt4) from DENV-2__EU482641__SS-prME
agcgccggcaugaucaucaugcugauccccaccgugauggccuuccaccugaccaccagaaacggcgagccccacaugaucgugggcauccaggagaagggcaagagccugcuguucaagaccgaggacggcgugaacaugugcacccugauggccauggaccugggcgagcugugcgaggacaccaucaccuacaagugcccccugcugagacagaacgagcccgaggacaucgacugcuggugcaacagcaccagcaccugggugaccuacggcaccugcaccaucaccggcgagcacagaagagagaagagaagcguggcccuggugccccacgugggcaugggccuggagaccagaaccgagaccuggaugagcagcgagggcgccuggaagcacgcccagagaaucgagaccuggauccugagacaccccggcuucaccaucauggccgccauccuggccuacaccaucggcaccacccacuuccagagagugcugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaaggaggagcaggacaagagauucgugugcaagcacagcaugguggacagaggcuggggcaacggcugcggccuguucggcaagggcggcaucgugaccugcgccauguucaccugcaagaagaacauggagggcaagaucgugcagcccgagaaccuggaguacaccaucguggugaccccccacagcggcgaggagcacgccgugggcaacgacaccggcaagcacggcauggagaucaaggugaccccccagagcagcaucaccgaggccgagcugaccggcuacggcaccgugaccauggagugcagccccagaaccggccuggacuucaacgagauggugcugcugcagauggagaacaaggccuggcuggugcacagacagugguuccuggaccugccccugcccuggcugcccggcgccgacaagcaggagagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucgugaucagagugcaguacgagggcgacggcagccccugcaagauccccuucgagaucauggaccuggagaagagauacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcaucgugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccaggaggagggcaucugcggcaucagaagcgugaccagacuggagaaccugauguggaagcagaucacccccgagcugaaccacauccuggccgagaacgaggugaagcugaccaucaugaccggcgacaucagaggcaucaugcaggccggcaagagaagccugagaccccagcccaccgagcugaaguacagcuggaagaccuggggcaaggccaagaugcugagcaccgagagcuacaaccagaccuuccugaucgacggccccgagaccgccgagugccccaacaccaacagagccuggaacagccuggagguggaggacuacggcuucggcguguucaccaccaacaucuggcugaagcugaaggagaagcaggacgccuucugcgacagcaagcugaugagcgccgccaucaaggacaacagagccgugcacgccgacaugggcuacuggaucgagagcgcccugaacgacaccuggaagaucgagaaggccagcuucaucgaggugaagaacugccacuggcccaagagccacacccuguggagcaacggcgugcuggagagcgagaugaucauccccaagaaccuggccggccccgugagccagcacaacuacagacccggcuaccacacccagaucgccggccccuggcaccugggcaagcuggagauggacuucgacuucugcgacggcaccaccgugaucgugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagguggacaacuucagccugggcgugcugggcauggcccuguuccuggaggagaugcugagaaccagagugggcaccaagcacgccauccugcugguggccgugagcuucgugacccugaucaccggcaacaugagcuucaaggaccugggcagagugguggugauggugggcgccaccauggccgacgacaucggcaugggcgugaccuaccuggcccugcuggccgccuucaaggugagacccaccuucgccgccggccugcugcugagaaagcugaccagcaaggagcugaugaugaccaccaucggcaucgugcugcugagccagagcaccauccccgagaccgugcuggagcugaccgacgcccuggcccugggcaugauggugcugaagaucgugagaaacauggagaaguaccagcuggccgugaccaucauggccauccugugcgugcccaacgccgugauccugcagaacgccuggaaggugagcugcaccauccuggccguggugagcgugagcccccugcugcugaccagcagccagcagaagaccgacuggaucccccuggcccugaccaucaagggccugaaccccaccgccaucuuccugaccacccugagcagaaccaacaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccaccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggccuguuccccaucagcauccccaucaccgccgccgccugguaccugugggaggugaagaagcagagagccggcgugcugugggacgugcccagccccccccccaugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacaagggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucaucgacaagaagggcaagguggugggccuguacggcaacggcguggugaccagaagcggcgccuacgugagcgccaucgcccagaccgagaagagcaucgaggacaaccccgagaucgaggacgacaucuucagaaagagaagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucaucgacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaagauggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaagaccagagacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcagaggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucgccacccagcagcccgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggaccccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaucccccccgagaagugcgacacccugcugugcgacaucggcgagagcagccccaaccccaccguggaggccggcagaacccugagagugcugaaccugguggagaacuggcugaacaacaacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccagcggcaacaucgugagcagcgugaacaugaucagcagaaugcugaucaacagauucaccaugagacacaagaaggccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacgugcugcccaccgugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcagauucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacauggagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcguguucaagaacauccagcaccugaccgugaccgaggagguggccgugcacaacuggcuggccagagugggcagagagagacugagcagaauggccaucagcggcgacgacugcguggugaagccccuggacgacagauucgccaacgcccugaccgcccugaacgacaugggcaagaucagaaaggacauccagcagugggagcccagcaagggcuggaacgacuggacccaggugcccuucugcagccaccacuuccacgagcugaucaugaaggacggcagaauccugguggugcccugcagaaaccaggacgagcugaucggcagagccagaaucagccagggcgccggcuggagccugagagagaccgccugccugggcaagagcuacgcccagauguggagccugauguacuuccacagaagagaccugagacuggccgccaacgccaucugcagcgccgugcccagccacugggugcccaccagcagaaccaccuggagcauccacgccaagcacgaguggaugaccaccgaggacaugcugaccguguggaacagaguguggaucagagagaaccccuggauggaggacaagacccccguggagagcugggaggagauccccuaccugggcaagagagaggaccaguggugcggcagccugaucggccugaccagcagagccaccugggccaagaacauccaggccgccaucaaccaggugagaagccugaucggcaacgaggaguacaccgacuacaugcccagcaugaagagauucagaagagaggaggaggaggccggcgugcugugguga

SEQ ID NO: 17457 - RNA, 9876 nt, Artificial Sequence
  derived and/or modified CDS sequence (opt4) from DENV-2__EU482642__SS-prME
agcgccggcaugaucaucaugcugauccccaccgugauggccuuccaccugaccaccagaaacggcgagccccacaugaucgugggcauccaggagaagggcaagagccugcuguucaagaccgaggacggcgugaacaugugcacccugauggccauggaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgcccagagaaucgagaccuggauccugagacaccccggcuucaccaucauggccgccauccuggccuacaccaucggcaccacccacuuccagagagugcugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaaggaggagcaggacaagagauucgugugcaagcacagcaugguggacagaggcuggggcaacggcugcggccuguucggcaagggcggcaucgugaccugcgccauguucaccugcaagaagaacauggagggcaagaucgugcagcccgagaaccuggaguacaccaucguggugaccccccacagcggcgaggagcacgccgugggcaacgacaccggcaagcacggcaaggagaucaaggugaccccccagagcagcaucaccgaggccgagcugaccggcuacggcaccgugaccauggagugcagccccagaaccggccuggacuucaacgagauggugcugcugcagauggagaacaaggccuggcuggugcacagacagugguuccuggaccugccccugcccuggcugcccggcgccgacaagcaggagagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucgugaucagagugcaguacgagggcgacggcagccccugcaagauccccuucgagaucauggaccuggagaagagauacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcaucgugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccaggaggagggcaucugcggcaucagaagcgugaccagacuggagaaccugauguggaagcagaucacccccgagcugaaccacauccuggccgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagcuacaaccagaccuuccugaucgacggccccgagaccgccgagugccccaacaccaacagagccuggaacagccuggagguggaggacuacggcuucggcguguucaccaccaacaucuggcugaagcugaaggagaagcaggacgccuucugcgacagcaagcugaugagcgccgccaucaaggacaacagagccgugcacgccgacaugggcuacuggaucgagagcgcccugaacgacaccuggaagaucgagaaggccagcuucaucgaggugaagaacugccacuggcccaagagccacacccuguggagcaacggcgugcuggagagcgagaugaucauccccaagaaccuggccggccccgugagccagcacaacuacagacccggcuaccacacccagaucgccggccccuggcaccugggcaagcuggagauggacuucgacuucugcgacggcaccaccgugaucgugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagguggacaacuucagccugggcgugcugggcauggcccuguuccuggaggagaugcugagaaccagagugggcaccaagcacgccauccugcugguggccgugagcuucgugacccugaucaccggcaacaugagcuucaaggaccugggcagagugguggugauggugggcgccaccauggccgacgacaucggcaugggcgugaccuaccuggcccugcuggccgccuucaaggugagacccaccuucgccgccggccugcugcugagaaagcugaccagcaaggagcugaugaugaccaccaucggcaucgugcugcugagccagagcaccauccccgagaccguguucgagcugaccgacgcccuggcccugggcaugauggugcugaagaucgugagaaacauggagaaguaccagcuggccgugaccaucauggccauccugugcgugcccaacgccgugauccugcagaacgccuggaaggugagcugcaccauccuggccguggugagcgugagcccccugcugcugaccagcagccagcagaagaccgacuggaucccccuggcccugaccaucaagggccugaaccccaccgccaucuuccugaccacccugagcagaaccaacaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccaccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggccuguuccccaucagcauccccaucaccgccgccgccugguaccugugggaggugaagaagcagagagccggcgugcugugggacgugcccagccccccccccaugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacaagggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucaucgacaagaagggcaagguggugggccuguacggcaacggcguggugaccagaagcggcgccuacgugagcgccaucgcccagaccgagaagagcaucgaggacaaccccgagaucgaggacgacaucuucagaaagagaagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucaucgacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaagauggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaagaccagagacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcagaggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucgccacccagcagcccgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggaccccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaugggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaucccccccgagaagugcgacacccugcugugcgacaucggcgagagcagccccaaccccaccguggaggccggcagaacccugagagugcugaaccugguggagaacuggcugaacaacaacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccagcggcaacaucgugagcagcgugaacaugaucagcagaaugcugaucaacagauucaccaugagacacaagaaggccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacgugcugcccaccgugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaucugcaccagagaggaguucaccagaaaggugagaagcaacgccgcccugggcgccaucuucaccgacgagaacaaguggaagagcgccagagaggccguggaggacagcagauucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacauggagggcgagcacaagaagcuggccgaggccaucuucaagcugaccuaccagaacaagguggugagagugcagagacccacccccagaggcaccgugauggacaucaucagcagaaaggaccagagaggcagcggccaggugggcaccuacggccugaacaccuucaccaacauggaggcccagcugaucagacagauggagggcgagggcguguucaagaacauccagcaccugaccgugaccgaggagguggccgugcagaacuggcuggccagagugggcagagagagacugagcagaauggccaucagcggcgacgacugcguggugaagccccuggacgacagauucgccaacgcccugaccgcccugaacgacaugggcaagaucagaaaggacauccagcagugggagcccagcaagggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugagagagaccgccugccugggcaagagcuacgcccagauguggagccugauguacuuccacagaagagaccugagacuggccgccaacgccaucugcagcgccgugcccagccacugggugcccaccagcagaaccaccuggagcauccacgccaagcacgaguggaugaccaccgaggacaugcugaccguguggaacagaguguggauccaggagaaccccuggauggaggacaagacccccguggagagcugggaggagauccccuaccugggcaagagagaggaccaguggugcggcagccugaucggccugaccagcagagccaccugggccaagaacauccaggccgccaucaaccaggugagaagccugaucggcaacgaggaguacaccgacuacaugcccagcaugaagagauucagaagagaggaggaggaggccggcgugcugugguga

SEQ ID NO: 17458 - RNA, 9876 nt, Artificial Sequence
  derived and/or modified CDS sequence (opt4) from DENV-2__EU482643__SS-prME
agcgccggcaugaucaucaugcugauccccaccgugauggccuuccaccugaccaccagaaacggcgagccccacaugaucgugggcauccaggagaagggcaagagccugcuguucaagaccgaggacggcgugaacaugugcacccugauggccauggaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgcccagagaaucgagaccuggauccugagacaccccggcuucaccaucauggccgccauccuggccuacaccaucggcaccacccacuuccagagagugcugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaaggaggagcaggacaagagauucgugugcaagcacagcaugguggacagaggcuggggcaacggcugcggccuguucggcaagggcggcaucgugaccugcgccauguucaccugcaagaagaacauggagggcaagaucgugcagcccgagaaccuggaguacaccaucguggugaccccccacagcggcgaggagcacgccgugggcaacgacaccggcaagcacggcaaggagaucaaggugaccccccagagcagcaucaccgaggccgagcugaccggcuacggcaccgugaccauggagugcagccccagaaccggccuggacuucaacgagauggugcugcugcagaugaagaacaaggccuggcuggugcacagacagugguuccuggaccugccccugcccuggcugcccggcgccgacaagcaggagagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucgugaucagagugcaguacgagggcgacggcagccccugcaagauccccuucgagaucauggaccuggagaagagauacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcaucgugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccaggaggagggcaucugcggcaucagaagcgugaccagacuggagaaccugauguggaagcagaucacccccgagcugaaccacauccuggccgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagcuacaaccagaccuuccugaucgacggccccgagaccaccgagugccccaacaccaacagagccuggaacagccuggagguggaggacuacggcuucggcguguucaccaccaacaucuggcugaagcugaaggagaagcaggacgccuucugcgacagcaagcugaugagcgccgccaucaaggacaacagagccgugcacgccgacaugggcuacuggaucgagagcgcccugaacgacaccuggaagaucgagaaggccagcuucaucgaggugaagaacugccacuggcccaagagccacacccuguggagcaacggcgugcuggagagcgagaugaucauccccaagaaccuggccggccccgugagccagcacaacuacagacccggcuaccacacccagaucgccggccccuggcaccugggcaagcuggagauggacuucgacuucugcgacggcaccaccgugaucgugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagguggacaacuucagccugggcgugcugggcauggcccuguuccuggaggagaugcugagaaccagagugggcaccaagcacgccauccugcuggugaccgugagcuucgugacccugaucaccggcaacaugagcuucaaggaccugggcagagugguggugauggugggcgccaccauggccgacgacaucggcaugggcgugaccuaccuggcccugcuggccgccuucaaggugagacccaccuucgccgccggccugcugcugagaaagcugaccagcaaggagcugaugaugaccaccaucggcaucgugcugcugagccagagcaccauccccgagaccgugcuggagcugaccgacgcccuggcccugggcaugauggugcugaagaucgugagaaacauggagaaguaccagcuggccgugaccaucauggccauccugugcgugcccaacgccgugauccugcagaacgccuggaaggugagcugcaccauccuggccguggugagcgugagcccccugcugcugaccagcagccagcagaagaccgacuggaucccccuggcccugaccaucaagggccugaaccccaccgccaucuuccugaccacccugagcagaaccaacaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccaccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggccuguuccccaucagcauccccaucaccgccgccgccugguaccugugggaggugaagaagcagagagccggcgugcugugggacgugcccagccccccccccaugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacaagggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucaucgacaagaagggcaagguggugggccuguacggcaacggcguggugaccagaagcggcgccuacgugagcgccaucgcccagaccgagaagagcaucgaggacaaccccgagaucgaggacgacaucuucagaaagagaagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucaucgacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaagauggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaagaccagagacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcagaggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucgccacccagcagcccgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggaccccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaucccccccgagaagugcgacacccugcugugcgacaucggcgagagcagccccaaccccaccguggaggccggcagaacccugagagugcugaaccugguggagaacuggcugaacaacaacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccagcggcaacaucgugagcagcgugaacaugaucagcagaaugcugaucaacagauucaccaugagacacaagaaggccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacgugcugcccaccgugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcagauucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacauggagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcguguucaagaacauccagcaccugaccgugaccgaggagguggccgugcagaacuggcuggccagagugggcagagagagacugagcagaauggccaucagcggcgacgacugcguggugaagccccuggacgacagauucgccaacgcccugaccgcccugaacgacaugggcaagaucagaaaggacauccagcagugggagcccagcaagggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugagagagaccgccugccugggcaagagcuacgcccagauguggagccugauguacuuccacagaagagaccugagacuggccgccaacgccaucugcagcgccgugcccagccacugggugcccaccagcagaaccaccuggagcauccacgccaagcacgaguggaugaccaccgaggacaugcugaccguguggaacagaguguggaucagagacaaccccuggauggaggacaagacccccguggagagcugggaggagauccccuaccugggcaagagagaggaccaguggugcggcagccugaucggccugaccagcagagccaccugggccaagaacauccaggccgccaucaaccaggugagaagccugaugggcaacgaggaguacaccgacuacaugcccagcaugaagagauucagaagagaggaggaggaggccggcgugcugugguga

SEQ ID NO: 17459 - RNA, 9876 nt, Artificial Sequence
  derived and/or modified CDS sequence (opt4) from DENV-2__EU482644__SS-prME
agcgccggcaugaucaucaugcugauccccaccgugauggccuuccaccugaccaccagaaacggcgagccccacaugaucgugggcauccaggagaagggcaagagccugcuguucaagaccgaggacggcgugaacaugugcacccugauggccauggaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgcccagagaaucgagaccuggauccugagacaccccggcuucaccaucauggccgccauccuggccuacaccaucggcaccacccacuuccagagagugcugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaaggaggagcaggacaagagauucgugugcaagcacagcaugguggacagaggcuggggcaacggcugcggccuguucggcaagggcggcaucgugaccugcgccauguucaccugcaagaagaacauggagggcaagaucgugcagcccgagaaccuggaguacaccaucguggugaccccccacagcggcgaggagcacgccgugggcaacgacaccggcaagcacggccaggagaucaaggugaccccccagagcagcaucaccgaggccgagcugaccggcuacggcaccgugaccauggagugcagccccagaaccggccuggacuucaacgagauggugcugcugcagauggagaacaaggccuggcuggugcacagacagugguuccuggaccugccccugcccuggcugcccggcgccgacaagcaggagagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucgugaucagagugcaguacgagggcgacggcagccccugcaagauccccuucgagaucauggaccuggagaagagauacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcaucgugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccaggaggagggcaucugcggcaucagaagcgugaccagacuggagaaccugauguggaagcagaucacccccgagcugaaccacauccuggccgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagcuacaaccagaccuuccugaucgacggccccgagaccgccgagugccccaacaccaacagagccuggaacagccuggagguggaggacuacggcuucggcguguucaccaccaacaucuggcugaagcugaaggagaagcaggacgccuucugcgacagcaagcugaugagcgccgccaucaaggacaacagagccgugcacgccgacaugggcuacuggaucgagagcgcccugaacgacaccuggaagaucgagaaggccagcuucaucgaggugaagaacugccacuggcccaagagccacacccuguggagcaacggcgugcuggagagcgagaugaucauccccaagaaccuggccggccccgugagccagcacaacuacagacccggcuaccacacccagaucgccggccccuggcaccugggcaagcuggagauggacuucgacuucugcgacggcaccaccgugaucgugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagguggacaacuucagccugggcgugcugggcauggcccuguuccuggaggagaugcugagaaccagagugggcaccaagcacgccauccugcugguggccgugagcuucgugacccugaucaccggcaacaugagcuucaaggaccugggcagagugguggugauggugggcgccaccauggccgacgacaucggcaccggcgugaccuaccuggcccugcuggccgccuucaaggugagacccaccuucgccgccggccugcugcugagaaagcugaccagcaaggagcugaugaugaccaccaucggcaucgugcugcugagccagagcaccauccccgagaccgugcuggagcugaccgacgcccuggcccugggcaugauggugcugaagaucgugagaaacauggagaaguaccagcuggccgugaccaucaugaccauccugugcgugcccaacgccgugauccugcagaacgccuggaaggugagcugcaccauccuggccguggugagcgugagcccccugcugcugaccagcagccagcagaagaccgacuggaucccccuggcccugaccaucaagggccugaaccccaccgccaucuuccugaccacccugagcagaaccaacaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccaccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggccuguuccccaucagcauccccaucaccgccgccgccugguaccugugggaggugaagaagcagagagccggcgugcugugggacgugcccagccccccccccaugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacaagggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucaucgacaagaagggcaagguggugggccuguacggcaacggcguggugaccagaagcggcgccuacgugagcgccaucgcccagaccgagaagagcaucgaggacaaccccgagaucgaggacgacaucuucagaaagagaagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucaucgacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaagauggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaagaccagagacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcagaggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucgccacccagcagcccgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggaccccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaugggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaucccccccgagaagugcgacacccugcugugcgacaucggcgagagcagccccaaccccaccguggaggccggcagaacccugagagugcugaaccugguggagaacuggcugaacaacaacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccagcggcaacaucgugagcagcgugaacaugaucagcagaaugcugaucaacagauucaccaugagacacaagaaggccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacgugcugcccaccgugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcagauucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacauggagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcguguucaagaacauccagcaccugaccgugaccgaggagguggccgugcagaacuggcuggccagagugggcagagagagacugagcagaauggccaucagcggcgacgacugcguggugaagccccuggacgacagauucgccaacgcccugaccgcccugaacgacaugggcaagaucagaaaggacauccagcagugggagcccagcaagggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugagagagaccgccugccugggcaagagcuacgcccagauguggagccugauguacuuccacagaagagaccugagacuggccgccaacgccaucugcagcgccgugcccagccacugggugcccaccagcagaaccaccuggagcauccacgccaagcacgaguggaugaccaccgaggacaugcugaccguguggaacagaguguggaucagagagaaccccuggauggaggacaagacccccguggagagcugggaggagauccccuaccugggcaagagagaggaccaguggugcggcagccugaucggccugaccagcagagccaccugggccaagaacauccaggccgccaucaaccaggugagaagccugaucggcaacgaggaguacaccgacuacaugcccagcaugaagagauucagaagagaggaggaggaggccggcgugcugugguga

SEQ ID NO: 17460 - RNA, 9876 nt, Artificial Sequence
  derived and/or modified CDS sequence (opt4) from DENV-2__EU482645__SS-prME
agcgccggcaugaucaucaugcugauccccaccgugauggccuuccaccugaccaccagaaacggcgagccccacaugaucgugggcauccaggagaagggcaagagccugcuguucaagaccgaggacggcgugaacaugugcacccugauggccauggaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgcccagagaaucgagaccuggauccugagacaccccggcuucaccaucauggccgccauccuggccuacaccaucggcaccacccacuuccagaaggugcugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaaggaggagcaggacaagagauucgugugcaagcacagcaugguggacagaggcuggggcaacggcugcggccuguucggcaagggcggcaucgugaccugcgccauguucaccugcaagaagaacauggagggcaagaucgugcagcccgagaaccuggaguacaccaucguggugaccccccacagcggcgaggagcacgccgugggcaacgacaccggcaagcacggccaggagaucaaggugaccccccagagcagcaucaccgaggccgagcugaccggcuacggcaccgugaccauggagugcagccccagaaccggccuggacuucaacgagauggugcugcugcagauggagaacaaggccuggcuggugcacagacagugguuccuggaccugccccugcccuggcugcccggcgccgacaagcaggagagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucgugaucagagugcaguacgagggcgacggcagccccugcaagauccccuucgagaucauggaccuggagaagagauacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcaucgugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccaggaggagggcaucugcggcaucagaagcgugaccagacuggagaaccugauguggaagcagaucacccccgagcugaaccacauccuggccgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagcuacaaccagaccuuccugaucgacggccccgagaccgccgagugccccaacaccaacagagccuggaacagccuggagguggaggacuacggcuucggcguguucaccaccaacaucuggcugaagcugaaggagaagcaggacgccuucugcgacagcaagcugaugagcgccgccaucaaggacaacagagccgugcacgccgacaugggcuacuggaucgagagcgcccugaacgacaccuggaagaucgagaaggccagcuucaucgaggugaagaacugccacuggcccaagagccacacccuguggagcaacggcgugcuggagagcgagaugaucauccccaagaaccuggccggccccgugagccagcacaacuacagacccggcuaccacacccagaucgccggccccuggcaccugggcaagcuggagauggacuucgacuucugcgacggcaccaccgugaucgugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagguggacaacuucagccugggcgugcugggcauggcccuguuccuggaggagaugcugagaaccagagugggcaccaagcacgccauccugcugguggccgugagcuucgugacccugaucaccggcaacaugagcuucaaggaccugggcagagugguggugauggugggcgccaccauggccgacgacaucggcaccggcgugaccuaccuggcccugcuggccgccuucaaggugagacccaccuucgccgccggccugcugcugagaaagcugaccagcaaggagcugaugaugaccaccaucggcaucgugcugcugagccagagcaccauccccgagaccgugcuggagcugaccgacgcccuggcccugggcaugauggugcugaagaucgugagaaacauggagaaguaccagcuggccgugaccaucaugaccauccugugcgugcccaacgccgugauccugcagaacgccuggaaggugagcugcaccauccuggccguggugagcgugagcccccugcugcugaccagcagccagcagaagaccgacuggaucccccuggcccugaccaucaagggccugaaccccaccgccaucuuccugaccacccugagcagaaccaacaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccaccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggccuguuccccaucagcauccccaucaccgccgccgccugguaccugugggaggugaagaagcagagagccggcgugcugugggacgugcccagccccccccccaugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacaagggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucaucgacaagaagggcaagguggugggccuguacggcaacggcguggugaccagaagcggcgccuacgugagcgccaucgcccagaccgagaagagcaucgaggacaaccccgagaucgaggacgacaucuucagaaagagaagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucaucgacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaagauggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaagaccagagacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcagaggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucgccacccagcagcccgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggaccccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaugggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaucccccccgagaagugcgacacccugcugugcgacaucggcgagagcagccccaaccccaccguggaggccggcagaacccugagagugcugaaccugguggagaacuggcugaacaacaacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccagcggcaacaucgugagcagcgugaacaugaucagcagaaugcugaucaacagauucaccaugagacacaagaaggccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacgugcugcccaccgugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcagauucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacauggagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcguguucaagaacauccagcaccugaccgugaccgaggagguggccgugcagaacuggcuggccagagugggcagagagagacugagcagaauggccaucagcggcgacgacugcguggugaagccccuggacgacagauucgccaacgcccugaccgcccugaacgacaugggcaagaucagaaaggacauccagcagugggagcccagcaagggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugagagagaccgccugccugggcaagagcuacgcccagauguggagccugauguacuuccacagaagagaccugagacuggccgccaacgccaucugcagcgccgugcccagccacugggugcccaccagcagaaccaccuggagcauccacgccaagcacgaguggaugaccaccgaggacaugcugaccguguggaacagaguguggaucagagagaaccccuggauggaggacaagacccccguggagagcugggaggagauccccuaccugggcaagagagaggaccaguggugcggcagccugaucggccugaccagcagagccaccugggccaagaacauccaggccgccaucaaccaggugagaagccugaucggcaacgaggaguacaccgacuacaugcccagcaugaagagauucagaagagaggaggaggaggccggcgugcugugguga

SEQ ID NO: 17461 - RNA, 9876 nt, Artificial Sequence
  derived and/or modified CDS sequence (opt4) from DENV-2__EU482646__SS-prME
agcgccggcaugaucaucaugcugauccccaccgugauggccuuccaccugaccaccagaaacggcgagccccacaugaucgugggcauccaggagaagggcaagagccugcuguucaagaccgaggacggcgugaacaugugcacccugauggccauggaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgcccagagaaucgagaccuggauccugagacaccccggcuucaccaucauggccgccauccuggccuacaccaucggcaccacccacuuccagagagugcugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaaggaggagcaggacaagagauucaucugcaagcacagcaugguggacagaggcuggggcaacggcugcggccuguucggcaagggcggcaucgugaccugcgccauguucaccugcaagaagaacauggagggcaagaucgugcagcccgagaaccuggaguacaccaucguggugaccccccacagcggcgaggagcacgccgugggcaacgacaccggcaagcacggcaaggagaucaaggugaccccccagagcagcaucaccgaggccgagcugaccggcuacggcaccgugaccauggagugcagccccagaaccggccuggacuucaacgagauggugcugcugcagauggagaacaaggccuggcuggugcacagacagugguuccuggaccugccccugcccuggcugcccggcgccgacaagcaggagagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucgugaucagagugcaguacgagggcgacggcagccccugcaagauccccuucgagaucauggaccuggagaagagauacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcaucgugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccaggaggagggcaucugcggcaucagaagcgugaccagacuggagaaccugauguggaagcagaucacccccgagcugaaccacauccuggccgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagcuacaaccagaccuuccugaucgacggccccgagaccgccgagugccccaacaccaacagagccuggaacagccuggagguggaggacuacggcuucggcguguucaccaccaacaucuggcugaagcugaaggagaagcaggacgccuucugcgacagcaagcugaugagcgccgccaucaaggacaacagagccgugcacgccgacaugggcuacuggaucgagagcgcccugaacgacaccuggaagaucgagaaggccagcuucaucgaggugaagaacugccacuggcccaagagccacacccuguggagcaacggcgugcuggagagcgagaugaucauccccaagaaccuggccggccccgugagccagcacaacuacagacccggcuaccacacccagaucgccggccccuggcaccugggcaagcuggagauggacuucgacuucugcgacggcaccaccgugaucgugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagguggacaacuucagccugggcgugcugggcauggcccuguuccuggaggagaugcugagaaccagagugggcaccaagcacgccauccugcugguggccgugagcuucgugacccugaucaccggcaacaugagcuucaaggaccugggcagagugguggugauggugggcgccaccauggccgacgacaucggcaugggcgugaccuaccuggcccugcuggccgccuucaaggugagacccaccuucgccgccggccugcugcugagaaagcugaccagcaaggagcugaugaugaccaccaucggcaucgugcugcugagccagagcaccauccccgagaccgugcuggagcugaccgacgcccuggcccugggcaugauggugcugaagaucgugagaaacauggagaaguaccagcuggccgugaccaucauggccauccugugcgugcccaacgccgugauccugcagaacgccuggaaggugagcugcaccauccuggccguggugagcgugagcccccugcugcugaccagcagccagcagaagaccgacuggaucccccuggcccugaccaucaagggccugaaccccaccgccaucuuccugaccacccugagcagaaccaacaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccaccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggccuguuccccaucagcauccccaucaccgccgccgccugguaccugugggaggugaagaagcagagagccggcgugcugugggacgugcccagccccccccccaugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacaagggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucaucgacaagaagggcaagguggugggccuguacggcaacggcguggugaccagaagcggcgccuacgugagcgccaucgcccagaccgagaagagcaucgaggacaaccccgagaucgaggacgacaucuucagaaagagaagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucaucgacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaagauggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaagaccagagacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcagaggcaucggcaagaugacccugggcaugugcugcaucaccaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucgccacccagcagcccgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggaccccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaugggcgagacccugggcgagaaguggaagagcagacugaacgcccugggcaagagcgaguuccagaucuacaagagaagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaucccccccgagaagugcgacacccugcugugcgacaucggcgagagcagccccaaccccaccguggaggccggcagaacccugagagugcugaaccugguggagaacuggcugaacaacaacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccagcggcaacaucgugagcagcgugaacaugaucagcagaaugcugaucaacagauucaccaugagacacaagaaggccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacgugcugcccaccgugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcagauucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacauggagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcguguucaagaacauccagcaccugaccgugaccgaggagguggccgugcagaacuggcuggccagagugggcagagagagacugagcagaauggccaucagcggcgacgacugcguggugaagccccuggacgacagauucgccaacgcccugaccgcccugaacgacaugggcaagaucagaaaggacauccagcagugggagcccagcaagggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugagagagaccgccugccugggcaagagcuacgcccagauguggagccugauguacuuccacagaagagaccugagacuggccgccaacgccaucugcagcgccgugcccagccacugggugcccaccagcagaaccaccuggagcauccacgccaagcacgaguggaugaccaccgaggacaugcugaccguguggaacagaguguggaucagagagaaccccuggauggaggacaagacccccguggagagcugggaggagauccccuaccugggcaagagagaggaccaguggugcggcagccugaucggccugaccagcagagccaccugggccaagaacauccaggccgccaucaaccaggugagaagccugaucggcaacgaggaguacaccgacuacaugcccagcaugaagagauucagaagagaggaggaggaggccggcgugcugugguga

SEQ ID NO: 17462 - RNA, 9876 nt, Artificial Sequence
  derived and/or modified CDS sequence (opt4) from DENV-2__EU482647__SS-prME
agcgccggcaugaucaucaugcugauccccaccgugauggccuuccaccugaccaccagaaacggcgagccccacaugaucgugggcauccaggagaagggcaagagccugcuguucaagaccgaggacggcgugaacaugugcacccugauggccauggaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgcccagagaaucgagaccuggauccugagacaccccggcuucaccaucauggccgccauccuggccuacaccaucggcaccacccacuuccagagagugcugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaaggaggagcaggacaagagauucgugugcaagcacagcaugguggacagaggcuggggcaacggcugcggccuguucggcaagggcggcaucgugaccugcgccauguucaccugcaagaagaacauggagggcaagaucgugcagcccgagaaccuggaguacaccaucguggugaccccccacagcggcgaggagcacgccgugggcaacgacaccggcaagcacggcaaggagaucaaggugaccccccagagcagcaucaccgaggccgagcugaccggcuacggcaccgugaccauggagugcagccccagaaccggccuggacuucaacgagauggugcugcugcagaugaagaacaaggccuggcuggugcacagacagugguuccuggaccugccccugcccuggcugcccggcgccgacaagcaggagagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucgugaucagagugcaguacgagggcgacggcagccccugcaagauccccuucgagaucauggaccuggagaagagauacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcaucgugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccaggaggagggcaucugcggcaucagaagcgugaccagacuggagaaccugauguggaagcagaucacccccgagcugaaccacauccuggccgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagcuacaaccagaccuuccugaucgacggccccgagaccgccgagugccccaacaccaacagagccuggaacagccuggagguggaggacuacggcuucggcguguucaccaccaacaucuggcugaagcugaaggagaagcaggacgccuucugcgacagcaagcugaugagcgccgccaucaaggacaacagagccgugcacgccgacaugggcuacuggaucgagagcgcccugaacgacaccuggaagaucgagaaggccagcuucaucgaggugaagaacugccacuggcccaagagccacacccuguggagcaacggcgugcuggagagcgagaugaucauccccaagaaccuggccggccccgugagccagcacaacuacagacccggcuaccacacccagaucgccggccccuggcaccugggcaagcuggagauggacuucgacuucugcgacggcaccaccgugaucgugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagguggacaacuucagccugggcgugcugggcauggcccuguuccuggaggagaugcugagaaccagagugggcaccaagcacgccauccugcugguggccgugagcuucgugacccugaucaccggcaacaugagcuucaaggaccugggcagagugguggugauggugggcgccaccauggccgacgacaucggcaugggcgugaccuaccuggcccugcuggccgccuucaaggugagacccaccuucgccgccggccugcugcugagaaagcugaccagcaaggagcugaugaugaccaccaucggcaucgugcugcugagccagagcaccauccccgagaccgugcuggagcugaccgacgcccuggcccugggcaugauggugcugaagaucgugagaaacauggagaaguaccagcuggccgugaccaucauggccauccugugcgugcccaacgccgugauccugcagaacgccuggaaggugagcugcaccauccuggccguggugagcgugagcccccugcugcugaccagcagccagcagaagaccgacuggaucccccuggcccugaccaucaagggccugaaccccaccgccaucuuccugaccacccugagcagaaccaacaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccaccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggccuguuccccaucagcauccccaucaccgccgccgccugguaccugugggaggugaagaagcagagagccggcgugcugugggacgugcccagccccccccccaugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacaagggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucaucgacaagaagggcaagguggugggccuguacggcaacggcguggugaccagaagcggcgccuacgugagcgccaucgcccagaccgagaagagcaucgaggacaaccccgagaucgaggacgacaucuucagaaagagaagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucaucgacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaagauggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaagaccagagacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcagaggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucgccacccagcagcccgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggaccccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaccuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaucccccccgagaagugcgacacccugcugugcgacaucggcgagagcagccccaaccccaccguggaggccggcagaacccugagagugcugaaccugguggagaacuggcugaacaacaacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccagcggcaacaucgugagcagcgugaacaugaucagcagaaugcugaucaacagauucaccaugagacacaagaaggccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacgugcugcccaccgugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcagauucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacauggagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcguguucaagaacauccagcaccugaccgugaccgaggagguggccgugcagaacuggcuggccagagugggcagagagagacugagcagaauggccaucagcggcgacgacugcguggugaagccccuggacgacagauucgccaacgcccugaccgcccugaacgacaugggcaagaucagaaaggacauccagcagugggagcccagcaagggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugagagagaccgccugccugggcaagagcuacgcccagauguggagccugauguacuuccacagaagagaccugagacuggccgccaacgccaucugcagcgccgugcccagccacugggugcccaccagcagaaccaccuggagcauccacgccaagcacgaguggaugaccaccgaggacaugcugaccguguggaacagaguguggaucagagagaaccccuggauggaggacaagacccccguggagagcugggaggagauccccuaccugggcaagagagaggaccaguggugcggcagccugaucggccugaccagcagagccaccugggccaagaacauccaggccgccaucaaccaggugagaagccugaucggcaacgaggaguacaccgacuacaugcccagcaugaagagauucagaagagaggaggaggaggccggcgugcugugguga

SEQ ID NO: 17463 - RNA, 9876 nt, Artificial Sequence
  derived and/or modified CDS sequence (opt4) from DENV-2__EU482648__SS-prME
accgccggcgugaucaucaugcugauccccaccgccauggccuuccaccugaccaccagaaacggcgagccccacaugaucgugggcagacaggagaagggcaagagccugcuguucaagaccgaggacggcgugaacaugugcacccugauggccaucgaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgcccagagaaucgagaccuggauccugagacaccccggcuucaccaucauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaacgaggagcaggacaagagauucgugugcaagcacagcaugguggacagaggcuggggcaacggcugcggccuguucggcaagggcggcaucgugaccugcgccauguucaccugcaagaagaacauggagggcaagaucgugcagcccgagaaccuggaguacaccaucgugaucaccccccacagcggcgaggagcacgccgugggcaacgacaccggcaagcacggcaaggagaucaagaucaccccccagagcagcaucaccgaggccgagcugaccggcuacggcaccgugaccauggagugcagccccagaaccggccuggacuucaacgagauggugcugcugcagauggaggacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagaucgugaaggagaucgccgagacccagcacggcaccaucgugaucagagugcaguacgagggcgacggcagccccugcaagauccccuucgagaucauggaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgccaucaucaccuggaucggcaugaacagcagaagcaccagccugagcgugagccuggugcuggugggcgugaucacccuguaccugggcgccauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucaccaccaacaucuggcugaagcugagagagaagcaggacguguucugcgacagcaagcugaugagcgccgccaucaaggacaacagagccgugcacgccgacaugggcuacuggaucgagagcgcccugaacgacaccuggaagauggagaaggccagcuucaucgaggugaagagcugccacuggcccaagagccacacccuguggagcaacggcgugcuggagagcgagaugaucauccccaagagcuucgccggccccgugagccagcacaacuacagacccggcuacuacacccagaccgccggccccuggcaccugggcaagcuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugguggccgugagcuucaugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugauggccaccaucggcaucgcccugcugagccagagcaccauccccgagaccauccuggagcugaccgacgcccuggcccugggcaugauggugcugaagaucgugagaaacauggagaaguaccagcuggccgugaccaucauggccaucagcugcgugcccaacgccgugauccugcagaacgccuggaaggugagcugcaccauccuggccgccgugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccaccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggccuguuccccgugagcauccccaucaccgccgccgccugguaccugugggaggugaagaagcagagagccggcgugcugugggacgugcccagccccccccccgugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacagaggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucguggacagaaagggcaagguggugggccuguacggcaacggcguggugaccagaagcggcgccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucaucgacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacagaguggccgccgagggcaucaacuacgccgacagaagauggugcuucgacggcgugaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagagacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcgugggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucgccacccaggagcccgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugaucgcccacuacgccaucaucggccccggccugcaggccaaggccaccagagaggcccagaagagagccgccgccggcaucaugaagaaccccaccguggacggcaucaccgugaucgaccuggaccccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccaucgaggccggcagaacccugagagugcugagccugguggagaacuggcugaacaacgacacccaguucugcaucaaggugcugaaccccuacaugcccagcgugaucgagaagauggagacccugcagagaaaguacggcggcgcccuggugagaaacccccugagcagaaacagcacccacgagauguacugggugagcaacgccaccggcaacaucgugagcagcgugaacaugaucagcagaaugcugaucaacagauucaccaugaagcacaagaaggccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacguggugcccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcagauucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacauggagggcgagcacaagagacuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcaucuucaagagcauccagcaccugaccgugaccgaggagaucgccgugcagaacuggcuggccagagugggcagagagagacugagcagaauggccaucagcggcgacgacugcguggugaagccccuggacgacagauucgccagcgcccugaccgcccugaacgacaugggcaaggugagaaaggacauccagcagugggagcccagcaagggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugaaggagaccgccugccugggcaagagcuacgcccagauguggagccugauguacuuccacagaagagaccugagacuggccgccaacgccaucugcagcgccgugcccagccacugggugcccaccagcagaaccaccuggagcauccacgccaagcacgaguggaugaccaccgaggacaugcugaccguguggaacagaguguggauccaggagaaccccuggauggaggacaagacccccguggagagcugggaggaggugcccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 17464 - RNA, 9876 nt, Artificial Sequence
  derived and/or modified CDS sequence (opt4) from DENV-2__EU482649__SS-prME
agcgccggcaugaucaucaugcugauccccaccgugauggccuuccaccugaccaccagaaacggcgagccccacaugaucgugggcauccaggagaagggcaagagccugcuguucaagaccgaggacggcgugaacaugugcacccugauggccauggaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgcccagagaaucgagaccuggauccugagacaccccggcuucaccaucauggccgccauccuggccuacaccaucggcaccacccacuuccagagagugcugaucuucauccugcugaccgccaucgcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaaggaggagcaggacaagagauucgugugcaagcacagcaugguggacagaggcuggggcaacggcugcggccuguucggcaagggcggcaucgugaccugcgccauguucaccugcaagaagaacauggagggcaagaucgugcagcccgagaaccuggaguacaccaucguggugaccccccacagcggcgaggagcacgccgugggcaacgacaccggcaagcacggcaaggagaucaaggugaccccccagagcagcaucaccgaggccgagcugaccggcuacggcaccgugaccauggagugcagccccagaaccggccuggacuucaacgagauggugcugcugcagauggagaacaaggccuggcuggugcacagacagugguuccuggaccugccccugcccuggcugcccggcgccgacaagcaggagagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucgugaucagagugcaguacgagggcgacggcagccccugcaagauccccuucgagaucauggaccuggagaagagauacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcaucgugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccaggaggagggcaucugcggcaucagaagcgugaccagacuggagaaccugauguggaagcagaucacccccgagcugaaccacauccuggccgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagcuacaaccagaccuuccugaucgacggccccgagaccgccgagugccccaacaccaacagagccuggaacagccuggagguggaggacuacggcuucggcguguucaccaccaacaucuggcugaagcugaaggagaagcaggacgccuucugcgacagcaagcugaugagcgccgccaucaaggacaacagagccgugcacgccgacaugggcuacuggaucgagagcgcccugaacgacaccuggaagaucgagaaggccagcuucaucgaggugaagaacugccacuggcccaagagccacacccuguggagcaacggcgugcuggagagcgagaugaucauccccaagaaccuggccggccccgugagccagcacaacuacagacccggcuaccacacccagaucgccggccccuggcaccugggcaagcuggagauggacuucgacuucugcgacggcaccaccgugaucgugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagguggacaacuucagccugggcgugcugggcauggcccuguuccuggaggagaugcugagaaccagagugggcaccaagcacgccauccugcugguggccgugagcuucgugacccugaucaccggcaacaugagcuucaaggaccugggcagagugguggugauggugggcgccaccauggccgacgacaucggcaugggcgugagcuaccuggcccugcuggccgccuucaaggugagacccaccuucgccgccggccugcugcugagaaagcugaccagcaaggagcugaugaugaccaccaucggcaucgugcugcugagccagagcaccauccccgagaccgugcuggagcugaccgacgcccuggcccugggcaugauggugcugaagaucgugagaaacauggagaaguaccagcuggccgugaccaucauggccauccugugcgugcccaacgccguggugcugcagaacgccuggaaggugagcugcaccauccuggccguggugagcgugagcccccugcugcugaccagcagccagcagaagaccgacuggaucccccuggcccugaccaucaagggccugaaccccaccgccaucuuccugaccacccugagcagaaccaacaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccaccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggccuguuccccaucagcauccccaucaccgccgccgccugguaccugugggaggugaagaagcagagagccggcgugcugugggacgugcccagccccccccccaugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacaagggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucaucgacaagaagggcaagguggugggccuguacggcaacggcguggugaccagaagcggcgccuacgugagcgccaucgcccagaccgagaagagcaucgaggacaaccccgagaucgaggacgacaucuucagaaagagaagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucaaggccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucaucgacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaagauggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaagaccagagacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcagaggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucgccacccagcagcccgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggaccccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaucccccccgagaagugcgacacccugcugugcgacaucggcgagagcagccccaaccccaccguggaggccggcagaacccugagagugcugaaccugguggagaacuggcugaacaacaacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccagcggcaacaucgugagcagcgugaacaugaucagcagaaugcugaucaacagauucaccaugagacacaagaaggccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacgugcugcccaccgugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcagauucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacauggagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcguguucaagaacauccagaaccugaccgugaccgaggagguggccgugcagaacuggcuggccagagugggcagagagagacugagcagaauggccaucagcggcgacgacugcguggugaagccccuggacgacagauucgccaacgcccugaccgcccugaacgacaugggcaagaucagaaaggacauccagcagugggagcccagcaagggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugagagagaccgccugccugggcaagagcuacgcccagauguggagccugauguacuuccacagaagagaccugagacuggccgccaacgccaucugcagcgccgugcccagccacugggugcccaccagcagaaccaccuggagcauccacgccaagcacgaguggaugaccaccgaggacaugcugaccguguggaacagaguguggaucagagagaaccccuggauggaggacaagacccccguggagagcugggaggagauccccuaccugggcaagagagaggaccaguggugcggcagccugaucggccugaccagcagagccaccugggccaagaacauccaggccgccaucaaccaggugagaagccugaucggcaacgaggaguacaccgacuacaugcccagcaugaagagauucagaagagaggaggaggaggccggcgugcugugguga

SEQ ID NO: 17465 - RNA, 9876 nt, Artificial Sequence
  derived and/or modified CDS sequence (opt4) from DENV-2__EU482650__SS-prME
agcgccggcaugaucaucaugcugauccccaccgugauggccuuccaccugaccaccagaaacggcgagccccacaugaucgugggcauccaggagaagggcaagagccugcuguucaagaccgaggacggcgugaacaugugcacccugauggccauggaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgcccagagaaucgagaccuggauccugagacaccccggcuucaccaucauggccgccauccuggccuacaccaucggcaccacccacuuccagagagugcugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaaggaggagcaggacaagagauucgugugcaagcacagcaugguggacagaggcuggggcaacggcugcggccuguucggcaagggcggcaucgugaccugcgccauguucaccugcaagaagaacauggagggcaagaucgugcagcccgagaaccuggaguacaccaucguggugaccccccacagcggcgaggagcacgccgugggcaacgacaccggcaagcacggccaggagaucaaggugaccccccagagcagcaucaccgaggccgagcugaccggcuacggcaccgugaccauggagugcagccccagaaccggccuggacuucaacgagauggugcugcugcagauggagaacaaggccuggcuggugcacagacagugguuccuggaccugccccugcccuggcugcccggcgccgacaagcaggagagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucgugaucagagugcaguacgagggcgacggcagccccugcaagauccccuucgagaucauggaccuggagaagagauacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcaucgugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccaggaggagggcaucugcggcaucagaagcgugaccagacuggagaaccugauguggaagcagaucacccccgagcugaaccacauccuggccgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagcuacaaccagaccuuccugaucgacggccccgagaccgccgagugccccaacaccaacagagccuggaacagccuggagguggaggacuacggcuucggcguguucaccaccaacaucuggcugaagcugaaggagaagcaggacgccuucugcgacagcaagcugaugagcgccgccaucaaggacaacagagccgugcacgccgacaugggcuacuggaucgagagcgcccugaacgacaccuggaagaucgagaaggccagcuucaucgaggugaagaacugccacuggcccaagagccacacccuguggagcaacggcgugcuggagagcgagaugaucauccccaagaaccuggccggccccgugagccagcacaacuacagacccggcuaccacacccagaucgccggccccuggcaccugggcaagcuggagauggacuucgacuucugcgacggcaccaccgugaucgugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagguggacaacuucagccugggcgugcugggcauggcccuguuccuggaggagaugcugagaaccagagugggcaccaagcacgccauccugcugguggccgugagcuucgugacccugaucaccggcaacaugagcuucaaggaccugggcagagugguggugauggugggcgccaccauggccgacgacaucggcaugggcgugaccuaccuggcccugcuggccgccuucaaggugagacccaccuucgccgccggccugcugcugagaaagcugaccagcaaggagcugaugaugaccaccaucggcaucgugcugcugagccagagcaccauccccgagaccgugcuggagcugaccgacgcccuggcccugggcaugauggugcugaagaucgugagaaacauggagaaguaccagcuggccgugaccaucauggccauccugugcgugcccaacgccgugauccugcagaacgccuggaaggugagcugcaccauccuggccguggugagcgugagcccccugcugcugaccagcagccagcagaagaccgacuggaucccccuggcccugaccaucaagggccugaaccccaccgccaucuuccugaccacccugagcagaaccaacaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccaccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggccuguuccccaucagcauccccaucaccgccgccgccugguaccugugggaggugaagaagcagagagccggcgugcugugggacgugcccagccccccccccaugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacaagggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucaucgacaagaagggcaagguggugggccuguacggcaacggcguggugaccagaagcggcgccuacgugagcgccaucgcccagaccgagaagagcaucgaggacaaccccgagaucgaggacgacaucuucagaaagagaagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucaucgacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaagauggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaagaccagagacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcagaggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucgccacccagcagcccgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggaccccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcaaguucuggaacaccaccaucgccgugagcauggccaacaucuucagaggcagcuaccuggccggcgccggccugcuguucagcaucaugaagaacaccaccaacaccagaagaggcaccggcaacaugggcgagacccugggcgagaaguggaagagcagacugaacacccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaucccccccgagaagugcgacacccugcugugcgacaucggcgagagcagccccaaccccaccguggaggccggcagaacccugagagugcugaaccugguggagaacuggcugaacaacaacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccagcggcaacaucgugagcagcgugaacaugaucagcagaaugcugaucaacagauucaccaugagacacaagaaggccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacgugcugcccaccgugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcagauucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacauggagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcguguucaagaacauccagcaccugaccgugaccgaggagguggccgugcagaacuggcuggccagagugggcagagagagacugagcagaauggccaucagcggcgacgacugcguggugaagccccuggacgacagauucgccaacgcccugaccgcccugaacgacaugggcaagaucagaaaggacauccagcagugggagcccagcaagggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugagagagaccgccugccugggcaagagcuacgcccagauguggagccugauguacuuccacagaagagaccugagacuggccgccaacgccaucugcagcgccgugcccagccacugggugcccaccagcagaaccaccuggagcauccacgccaagcacgaguggaugaccaccgaggacaugcugaccguguggaacagaguguggaucagagagaaccccuggauggaggacaagacccccguggagagcugggaggagauccccuaccugggcaagagagaggaccaguggugcggcagccugaucggccugaccagcagagccaccugggccaagaacauccaggccgccaucaaccaggugagaagccugaucggcaacgaggaguacaccgacuacaugcccagcaugaagagauucagaagagaggaggaggaggccggcgugcugugguga

SEQ ID NO: 17466 - RNA, 9876 nt, Artificial Sequence
  derived and/or modified CDS sequence (opt4) from DENV-2__EU482651__SS-prME
agcgccggcaugaucaucaugcugauccccaccgugauggccuuccaccugaccaccagaaacggcgagccccacaugaucgugggcauccaggagaagggcaagagccugcuguucaagaccgaggacggcgugaacaugugcacccugauggccauggaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgcccagagaaucgagaccuggauccugagacaccccggcuucaccaucauggccgccauccuggccuacaccaucggcaccacccacuuccagagagugcugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaaggaggagcaggacaagagauucgugugcaagcacagcaugguggacagaggcuggggcaacggcugcggccuguucggcaagggcggcaucgugaccugcgccauguucaccugcaagaagaacauggagggcaagaucgugcagcccgagaaccuggaguacaccaucguggugaccccccacagcggcgaggagcacgccgugggcaacgacaccggcaagcacggcaaggagaucaaggugaccccccagagcagcaucaccgaggccgagcugaccggcuacggcaccgugaccauggagugcagccccagaaccggccuggacuucaacgagauggugcugcugcagauggagaacaaggccuggcuggugcacagacagugguuccuggaccugccccugcccuggcugcccggcgccgacaagcaggagagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucgugaucagagugcaguacgagggcgacggcagccccugcaagauccccuucgagaucauggaccuggagaagagauacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcaucgugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccaggaggagggcaucugcggcaucagaagcgugaccagacuggagaaccugauguggaagcagaucacccccgagcugaaccacauccuggccgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagcuacaaccagaccuuccugaucgacggccccgagaccgccgagugccccaacaccaacagagccuggaacagccuggagguggaggacuacggcuucggcguguucaccaccaacaucuggcugagacugaaggagaagcaggacgccuucugcgacagcaagcugaugagcgccgccaucaaggacaacagagccgugcacgccgacaugggcuacuggaucgagagcgcccugaacgacaccuggaagaucgagaaggccagcuucaucgaggugaagaacugccacuggcccaagagccacacccuguggagcaacggcgugcuggagagcgagaugaucauccccaagaaccuggccggccccgugagccagcacaacuacagacccggcuaccacacccagaucaccggccccuggcaccugggcaagcuggagauggacuucgacuucugcgacggcaccaccgugaucgugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagguggacaacuucagccugggcgugcugggcauggcccuguuccuggaggagaugcugagaaccagagugggcaccaagcacgccauccugcuggugaccgugagcuucgugacccugaucaccggcaacaugagcuucaaggaccugggcagagugguggugauggugggcgccaccauggccgacgacaucggcaugggcgugaccuaccuggcccugcuggccgccuucaaggugagacccaccuucgccgccggccugcugcugagaaagcugaccagcaaggagcugaugaugaccaccaucggcaucgugcugcugagccagagcaccauccccgagaccgugcuggagcugaccgacgcccuggcccugggcaugauggugcugaagaucgugagaaacauggagaaguaccagcuggccgugaccaucauggccauccugugcgugcccaacgccguggugcugcagaacgccuggaaggugagcugcaccauccuggccguggugagcgugagcccccugcugcugaccagcagccagcagaagaccgacuggaucccccuggcccugaccaucaagggccugaaccccaccgccaucuuccugaccacccugagcagaaccaacaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccaccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggccuguuccccaucagcauccccaucaccgccgccgccugguaccugugggaggugaagaagcagagagccggcgugcugugggacgugcccagccccccccccaugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacaagggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucaucgacaagaagggcaagguggugggccuguacggcaacggcguggugaccagaagcggcgccuacgugagcgccaucgcccagaccgagaagagcaucgaggacaaccccgagaucgaggacgacaucuucagaaagagaagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucaaggccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucaucgacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaagauggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaagaccagagacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcagaggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucgccacccagcagcccgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggaccccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaucccccccgagaagugcgacacccugcugugcgacaucggcgagagcagccccaaccccaccguggaggccggcagaacccugagagugcugaaccugguggagaacuggcugaacaacaacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccagcggcaacaucgugagcagcgugaacaugaucagcagaaugcugaucaacagauucaccaugagacacaagaaggccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacgugcugcccaccgugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcagauucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacauggagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcguguucaagaacauccagcaccugaccgugaccgaggagguggccgugcagaacuggcuggccagagugggcagagagagacugagcagaauggccaucagcggcgacgacugcguggugaagccccuggacgacagauucgccaacgcccugaccgcccugaacgacaugggcaagaucagaaaggacauccagcagugggagcccagcaagggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugagagagaccgccugccugggcaagagcuacgcccagauguggagccugauguacuuccacagaagagaccugagacuggccgccaacgccaucugcagcgccgugcccagccacugggugcccaccagcagaaccaccuggagcauccacgccaagcacgaguggaugaccaccgaggacaugcugaccguguggaacagaguguggaucagagagaaccccuggauggaggacaagacccccguggagagcugggaggagauccccuaccugggcaagagagaggaccaguggugcggcagccugaucggccugaccagcagagccaccugggccaagaacauccaggccgccaucaaccaggugagaagccugaucggcaacgaggaguacaccgacuacaugcccagcaugaagagauucagaagagaggaggaggaggccggcgugcugugguga

SEQ ID NO: 17467 - RNA, 9876 nt, Artificial Sequence
  derived and/or modified CDS sequence (opt4) from DENV-2__EU482652__SS-prME
agcgccggcaugaucaucaugcugauccccaccgugauggccuuccaccugaccaccagaaacggcgagccccacaugaucgugggcauccaggagaagggcaagagccugcuguucaagaccgaggacggcgugaacaugugcacccugauggccauggaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgcccagagaaucgagaccuggauccugagacaccccggcuucaccaucauggccgccauccuggccuacaccaucggcaccacccacuuccagagagugcugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaaggaggagcaggacaagagauucgugugcaagcacagcaugguggacagaggcuggggcaacggcugcggccuguucggcaagggcggcaucgugaccugcgccauguucaccugcaagaagaacauggagggcaagaucgugcagcccgagaaccuggaguacaccaucguggugaccccccacagcggcgaggagcacgccgugggcaacgacaccggcaagcacggccaggagaucaaggugaccccccagagcagcaucaccgaggccgagcugaccggcuacggcaccgugaccauggagugcagccccagaaccggccuggacuucaacgagauggugcugcugcagauggagaacaaggccuggcuggugcacagacagugguuccuggaccugccccugcccuggcugcccggcgccgacaagcaggagagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagccugugcaccggcaaguucaagguggugaaggagaucgccgagacccagcacggcaccaucgugaucagagugcaguacgagggcgacggcagccccugcaagauccccuucgagaucauggaccuggagaagagauacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcaucgugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccaggaggagggcaucugcggcaucagaagcgugaccagacuggagaaccugauguggaagcagaucacccccgagcugaaccacauccuggccgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagcuacaaccagaccuuccugaucgacggccccgagaccgccgagugccccaacaccaacagagccuggaacagccuggagguggaggacuacggcuucggcguguucaccaccaacaucuggcugaagcugaaggagaagcaggacgccuucugcgacagcaagcugaugagcgccgccaucaaggacaacagagccgugcacgccgacaugggcuacuggaucgagagcgcccugaacgacaccuggaagaucgagaaggccagcuucaucgaggugaagaacugccacuggcccaagagccacacccuguggagcaacggcgugcuggagagcgagaugaucauccccaagaaccuggccggccccgugagccagcacaacuacagacccggcuaccacacccagaucgccggccccuggcaccugggcaagcuggagauggacuucgacuucugcgacggcaccaccgugaucgugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagguggacaacuucagccugggcgugcugggcauggcccuguuccuggaggagaugcugagaaccagagugggcaccaagcacgccauccugcugguggccgugagcuucgugacccugaucaccggcaacaugagcuucaaggaccugggcagagugguggugauggugggcgccaccaugaccgacgacaucggcaugggcgugaccuaccuggcccugcuggccgccuucaaggugagacccaccuucgccgccggccugcugcugagaaagcugaccagcaaggagcugaugaugaccaccaucggcaucgugcugcugagccagagcgccauccccgagaccgugcuggagcugaccgacgcccuggcccugggcaugauggugcugaagaucgugagaaacauggagaaguaccagcuggccgugaccaucauggccauccugugcgugcccaacgccgugauccugcagaacgccuggaaggugagcugcaccauccuggccguggugagcgugagcccccugcugcugaccagcagccagcagaagaccgacuggaucccccuggcccugaccaucaagggccugaaccccaccgccaucuuccugaccacccugagcagaaccaacaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccaccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggccuguuccccaucagcauccccaucaccgccgccgccugguaccugugggaggugaagaagcagagagccggcgugcugugggacgugcccagccccccccccaugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacaagggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucaucgacaagaagggcaagguggugggccuguacggcaacggcguggugaccagaagcggcgccuacgugagcgccaucgcccagaccgagaagagcaucgaggacaaccccgagaucgaggacgacaucuucagaaagagaagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucaucgacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaagauggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaagaccagagacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcagaggcaucggcaagaugacccugggcaugugcugcaucaucaccgccagcacccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucgccacccagcagcccgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggaccccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaugggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaucccccccgagaagugcgacacccugcugugcgacaucggcgagagcagccccaaccccaccguggaggccggcagaacccugagagugcugaaccugguggagaacuggcugaacaacaacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccagcggcaacaucgugagcagcgugaacaugaucagcagaaugcugaucaacagauucaccaugagacacaagaaggccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacgugcugcccaccgugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcagauucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacauggagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcguguucaagaacauccagcaccugaccgugaccgaggagguggccgugaagaacuggcuggccagagugggcagagagagacugagcagaauggccaucagcggcgacgacugcguggugaagccccuggacgacagauucgccaacgcccugaccgcccugaacgacaugggcaagaucagaaaggacauccagcagugggagcccagcaagggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugagagagaccgccugccugggcaagagcuacgcccagauguggagccugauguacuuccacagaagagaccugagacuggccgccaacgccaucugcagcgccgugcccagccacugggugcccaccagcagaaccaccuggagcauccacgccaagcacgaguggaugaccaccgaggacaugcugaccguguggaacagaguguggaucagagagaaccccuggauggaggacaagacccccguggagagcugggaggagauccccuaccugggcaagagagaggaccaguggugcggcagccugaucggccugaccagcagagccaccugggccaagaacauccaggccgccaucaaccaggugagaagccugaucggcaacgaggaguacgccgacuacaugcccagcaugaagagauucagaagagaggaggaggaggccggcgugcugugguga

SEQ ID NO: 17468 - RNA, 9876 nt, Artificial Sequence
  derived and/or modified CDS sequence (opt4) from DENV-2__EU482653__SS-prME
agcgccggcaugaucaucaugcugauccccaccgugauggccuuccaccugaccaccagaaacggcgagccccacaugaucgugggcauccaggagaagggcaagagccugcuguucaagaccgaggacggcgugaacaugugcacccugauggccauggaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgcccagagaaucgagaccuggauccugagacaccccggcuucaccaucauggccgccauccuggccuacaccaucggcaccacccacuuccagagagugcugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaaggaggagcaggacaagagauucgugugcaagcacagcaugguggacagaggcuggggcaacggcugcggccuguucggcaagggcggcaucgugaccugcgccauguucaccugcaagaagaacauggagggcaagaucgugcagcccgagaaccuggaguacaccaucguggugaccccccacagcggcgaggagcacgccgugggcaacgacaccggcaagcacggcaaggagaucaaggugaccccccagagcagcaucaccgaggccgagcugaccggcuacggcaccgugaccauggagugcagccccagaaccggccuggacuucaacgagauggugcugcugcagauggagaacaaggccuggcuggugcacagacagugguuccuggaccugccccugcccuggcugcccggcgccgacaagcaggagagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucgugaucagagugcaguacgagggcgacggcagccccugcaagauccccuucgagaucauggaccuggagaagagauacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcaucgugacccuguaccugggcgugauggugcaggccgacagcggcugcguggugagcuggaagaacaaggagcugaagugcggcagcggcaucuucgugaccgacaacgugcacaccuggaccgagcaguacaaguuccagcccgagagccccagcaagcuggccagcgccauccagaaggcccaggaggagggcaucugcggcaucagaagcgugaccagacuggagaaccugauguggaagcagaucacccccgagcugaaccacauccuggccgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucaccaccaacaucuggcugagacugaaggagaagcaggacgccuucugcgacagcaagcugaugagcgccgccaucaaggacaacagagccgugcacgccgacaugggcuacuggaucgagagcgcccugaacgacaccuggaagaucgagaaggccagcuucaucgaggugaagaacugccacuggcccaagagccacacccuguggagcaacggcgugcuggagagcgagaugaucauccccaagaaccuggccggccccgugagccagcacaacuacagacccggcuaccacacccagaucgccggccccuggcaccugggcaagcuggagauggacuucgacuucugcgacggcaccaccgugaucgugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagguggacaacuucagccugggcgugcugggcauggcccuguuccuggaggagaugcugagaaccagagugggcaccaagcacgccauccugcugguggccgugagcuucgugacccugaucaccggcaacaugagcuucaaggaccugggcagagugguggugauggugggcgccaccauggccgacgacaucggcaugggcgugaccuaccuggcccugcuggccgccuucaaggugagacccaccuucgccgccggccugcugcugagaaagcugaccagcaaggagcugaugaugaccaccaucggcaucgugcugcugagccagagcaccauccccgagaccgugcuggagcugaccgacgcccuggcccugggcaugauggugcugaagaucgugagaaacauggagaaguaccagcuggccgugaccaucauggccauccugugcgugcccaacgccgugauccugcagaacgccuggaaggugagcugcaccauccuggccguggugagcgugagcccccugcugcugaccagcagccagcagaagaccgacuggaucccccuggcccugaccaucaagggccugaaccccaccgccaucuuccugaccacccugagcagaaccaacaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccaccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggccuguuccccaucagcauccccaucaccgccgccgccugguaccugugggaggugaagaagcagagagccggcgugcugugggacgugcccagccccccccccaugggcaaggccgagcuggaggacggcgccuacagaaucaagcagaagggcaucuucggcuacagccagaucggcgccggcguguacaaggagggcaccuuccacaccauguggcacgugaccagaggcgccgugcugaugcacaagggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucaucgacaagaagggcaagguggugggccuguacggcaacggcguggugaccagaagcggcgccuacgugagcgccaucgcccagaccgagaagagcaucgaggacaaccccgagaucgaggacgacaucuucagaaagagaagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucaucgacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaagauggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaagaccagagacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcagaggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucgccacccagcagcccgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggaccccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacgccagaagaggcaccggcaacaugggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaucccccccgagaagugcgacacccugcugugcgacaucggcgagagcagccccaaccccaccguggaggccggcagaacccugagagugcugaaccugguggagaacuggcugaacaacaacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccagcggcaacaucgugagcagcgugaacaugaucagcagaaugcugaucaacagauucaccaugagacacaagaaggccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacgugcugcccaccgugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcagauucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacauggagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcguguucaagaacauccagcaccugaccgugaccgaggagguggccgugcagaacuggcuggccagagugggcagagagagacugagcagaauggccaucagcggcgacgacugcguggugaagccccuggacgacagauucgccaacgcccugaccgcccugaacgacaugggcaagaucagaaaggacauccagcagugggagcccagcaagggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugagagagaccgccugccugggcaagagcuacgcccagauguggagccugauguacuuccacagaagagaccugagacuggccgccaacgccaucugcagcgccgugcccagccacugggugcccaccagcagaaccaccuggagcauccacgccaagcacgaguggaugaccaccgaggacaugcugaccguguggaacagaguguggaucagagagaaccccuggauggaggacaagacccccguggagagcugggaggagauccccuaccugggcaagagagaggaccaguggugcggcagccugaucggccugaccagcagagccaccugggccaagaacauccaggccgccaucaaccaggugagaagccugaucggcaacgaggaguacaccgacuacaugcccagcaugaagagauucagaagagaggaggaggaggccggcgugcugugguga

SEQ ID NO: 17469 - RNA, 9876 nt, Artificial Sequence
  derived and/or modified CDS sequence (opt4) from DENV-2__EU482654__SS-prME
agcgccggcaugaucaucaugcugauccccaccgugauggccuuccaccugaccaccagaaacggcgagccccacaugaucgugggcauccaggagaagggcaagagccugcuguucaagaccgaggacggcgugaacaugugcacccugauggccauggaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgcccagagaaucgagaccuggauccugagacaccccggcuucaccaucauggccgccauccuggccuacaccaucggcaccacccacuuccagagagugcugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaaggaggagcaggacaagagauucgugugcaagcacagcaugguggacagaggcuggggcaacggcugcggccuguucggcaagggcggcaucgugaccugcgccauguucaccugcaagaagaacauggagggcaagaucgugcagcccgagaaccuggaguacaccaucguggugaccccccacagcggcgaggagcacgccgugggcaacgacaccggcaagcacggccaggagaucaaggugaccccccagagcagcaucaccgaggccgagcugaccggcuacggcaccgugaccauggagugcagccccagaaccggccuggacuucaacgagauggugcugcugcagauggagaacaaggccuggcuggugcacagacagugguuccuggaccugccccugcccuggcugcccggcgccgacaagcaggagagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucgugaucagagugcaguacgagggcgacggcagccccugcaagauccccuucgagaucauggaccuggagaagagauacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcaucgugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccaggaggagggcaucugcggcaucagaagcgugaccagacuggagaaccugauguggaagcagaucacccccgagcugaaccacauccuggccgagaacgaggugaagaugaccaucaugaccggcgacaucaagggcaucaugcaggccggcaagagaagccugagaccccagcccaccgagcugaaguacagcuggaagaccuggggcaaggccaagaugcugagcaccgagagcuacaaccagaccuuccugaucgacggccccgagaccgccgagugccccaacaccaacagagccuggaacagccuggagguggaggacuacggcuucggcguguucaccaccaacaucuggcugaagcugaaggagaagcaggacgccuucugcgacagcaagcugaugagcgccgccaucaaggacaacagagccgugcacgccgacaugggcuacuggaucgagagcgcccugaacgacaccuggaagaucgagaaggccagcuucaucgaggugaagaacugccacuggcccaagagccacacccuguggagcaacggcgugcuggagagcgagaugaucauccccaagaaccuggccggccccgugagccagcacaacuacagacccggcuaccacacccagaucgccggccccuggcaccugggcaagcuggagauggacuucgacuucugcgacggcaccaccgugaucgugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagguggacaacuucagccugggcgugcugggcauggcccuguuccuggaggagaugcugagaaccagagugggcaccaagcacgccauccugcugguggccgugagcuucgugacccugaucaccggcaacaugagcuucaaggaccugggcagagugguggugauggugggcgccaccauggccgacgacaucggcaugggcgugaccuaccuggcccugcuggccgccuucaaggugagacccaccuucgccgccggccugcugcugagaaagcugaccagcaaggagcugaugaugaccaccaucggcaucgugcugcugagccagagcaccauccccgagaccgugcuggagcugaccgacgcccuggcccugggcaugauggugcugaagaucgugagaaacauggagaaguaccagcuggccgugaccaucauggccauccugugcgugcccaacgccgugauccugcagaacgccuggaaggugagcugcaccauccuggccguggugagcgugagcccccugcugcugaccagcagccagcagaagaccgacuggaucccccuggcccugaccaucaagggccugaaccccaccgccaucuuccugaccacccugagcagaaccaacaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccaccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggccuguuccccaucagcauccccaucaccgccgccgccugguaccugugggaggugaagaagcagagagccggcgugcugugggacgugcccagccccccccccaugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacaagggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucaucgacaagaagggcaagguggugggccuguacggcaacggcguggugaccagaagcggcgccuacgugagcgccaucgcccagaccgagaagagcaucgaggacaaccccgagaucgaggacgacaucuucagaaagagaagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucaucgacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaagauggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaagaccagagacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcagaggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucgccacccagcagcccgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggaccccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaugggcgagacccugggcgagaaguggaagagcagacugaacacccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaucccccccgagaagugcgacacccugcugugcgacaucggcgagagcagccccaaccccaccguggaggccggcagaacccugagagugcugaaccugguggagaacuggcugaacaacaacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccagcggcaacaucgugagcagcgugaacaugaucagcagaaugcugaucaacagauucaccaugagacacaagaaggccaccuacgagcccgacguggaccugggcagcggcaccagaaacaucggcaucgagagcgagacccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacgugcugcccaccgugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcagauucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacauggagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcguguucaagaacauccagcaccugaccgugaccgaggagguggccgugcagaacuggcuggccagagugggcagagagagacugagcagaauggccaucagcggcgacgacugcguggugaagccccuggacgacagauucgccaacgcccugaccgcccugaacgacaugggcaagaucagaaaggacauccagcagugggagcccagcaagggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugagagagaccgccugccugggcaagagcuacgcccagauguggagccugauguacuuccacagaagagaccugagacuggccgccaacgccaucugcagcgccgugcccagccacugggugcccaccagcagaaccaccuggagcauccacgccaagcacgaguggaugaccaccgaggacaugcugaccguguggaacagaguguggaucagagagaaccccuggauggaggacaagacccccguggagagcugggaggagauccccuaccugggcaagagagaggaccaguggugcggcagccugaucggccugaccagcagagccaccugggccaagaacauccaggccgccaucaaccaggugagaagccugaucggcaacgaggaguacaccgacuacaugcccagcaugaagagauucagaagagaggaggaggaggccggcgugcugugguga

SEQ ID NO: 17470 - RNA, 9876 nt, Artificial Sequence
  derived and/or modified CDS sequence (opt4) from DENV-2__EU482656__SS-prME
agcgccggcaugaucaucaugcugauccccaccgugauggccuuccaccugaccaccagaaacggcgagccccacaugaucgugggcauccaggagaagggcaagagccugcuguucaagaccgaggacggcgugaacaugugcacccugauggccauggaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgcccagagaaucgagaccuggauccugagacaccccggcuucaccaucauggccgccauccuggccuacaccaucggcaccacccacuuccagagagugcugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaaggaggagcaggacaagagauucgugugcaagcacagcaugguggacagaggcuggggcaacggcugcggccuguucggcaagggcggcaucgugaccugcgccauguucaccugcaagaagaacauggagggcaagaucgugcagcccgagaaccuggaguacaccaucguggugaccccccacagcggcgaggagcacgccgugggcaacgacaccggcaagcacggcaaggagaucaaggugaccccccagagcagcaucaccgaggccgagcugaccggcuacggcaccgugaccauggagugcagccccagaaccggccuggacuucaacgagauggugcugcugcagauggagaacaaggccuggcuggugcacagacagugguuccuggaccugccccugcccuggcugcccggcgccgacaagcaggagagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucgugaucagagugcaguacgagggcgacggcagccccugcaagauccccuucgagaucauggaccuggagaagagauacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcaucgugacccuguaccugggcgugauggugcaggccgacagcggcugcguggugagcuggaagaacaaggagcugaagugcggcagcggcaucuucgugaccgacaacgugcacaccuggaccgagcaguacaaguuccagcccgagagccccagcaagcuggccagcgccauccagaaggcccaggaggagggcaucugcggcaucagaagcgugaccagacuggagaaccugauguggaagcagaucacccccgagcugaaccacauccuggccgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucaccaccaacaucuggcugaagcugaaggagaagcaggacgccuucugcgacagcaagcugaugagcgccgccaucaaggacaacagagccgugcacgccgacaugggcuacuggaucgagagcgcccugaacgacaccuggaagaucgagaaggccagcuucaucgaggugaagaacugccacuggcccaagagccacacccuguggagcaacggcgugcuggagagcgagaugaucauccccaagaaccuggccggccccgugagccagcacaacuacagacccggcuaccacacccagaucgccggccccuggcaccugggcaagcuggagauggacuucgacuucugcgacggcaccaccgugaucgugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagguggacaacuucagccugggcgugcugggcauggcccuguuccuggaggagaugcugagaaccagagugggcaccaagcacgccauccugcugguggccgugagcuucgugacccugaucaccggcaacaugagcuucaaggaccugggcagagugguggugauggugggcgccaccauggccgacgacaucggcaugggcgugaccuaccuggcccugcuggccgccuucaaggugagacccaccuucgccgccggccugcugcugagaaagcugaccagcaaggagcugaugaugaccaccaucggcaucgugcugcugagccagagcaccauccccgagaccgugcuggagcugaccgacgcccuggcccugggcaugauggugcugaagaucgugagaaacauggagaaguaccagcuggccgugaccaucauggccauccugugcgugcccaacgccgugauccugcagaacgccuggaaggugagcugcaccauccuggccguggugagcgugagcccccugcugcugaccagcagccagcagaagaccgacuggaucccccuggcccugaccaucaagggccugaaccccaccgccaucuuccugaccacccugagcagaaccaacaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccaccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggccuguuccccaucagcauccccaucaccgccgccgccugguaccugugggaggugaagaagcagagagccggcgugcugugggacgugcccagccccccccccaugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacaagggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucaucgacaagaagggcaagguggugggccuguacggcaacggcguggugaccagaagcggcgccuacgugagcgccaucgcccagaccgagaagagcaucgaggacaaccccgagaucgaggacgacaucuucagaaagagaagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccauccuggacgaggagagagagauccccgagagaagcuggaacagcggccacgagugggugaccgacuucgagggcaagaccgugugguucgugcccagcaucaaggccggcaacgacaucgccgccugccugagaaagaacggcaagaaggugauccagcugagcagaaagaccuucgacagcgaguacgugaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaagauggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaagaccagagacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcagaggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcguggccacccagcagcccgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggaccccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaugggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaucccccccgagaagugcgacacccugcugugcgacaucggcgagagcagccccaaccccaccguggaggccggcagaacccugagagugcugaaccugguggagaacuggcugaacaacaacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccagcggcaacaucgugagcagcgugaacaugaucagcagaaugcugaucaacagauucaccaugagacacaagaaggccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacgugcugcccaccgugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcagauucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacauggagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcguguucaagaacauccagcaccugaccgugaccgaggagguggccgugcagaacuggcuggccagagugggcagagagagacugagcagaauggccaucagcggcgacgacugcguggugaagccccuggacgacagauucgccaacgcccugaccgcccugaacgacaugggcaagaucagaaaggacauccagcagugggagcccagcaagggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugagagagaccgccugccugggcaagagcuacgcccagauguggagccugauguacuuccacagaagagaccugagacuggccgccaacgccaucugcagcgccgugcccagccacugggugcccaccagcagaaccaccuggagcauccacgccaagcacgaguggaugaccaccgaggacaugcugaccguguggaacagaguguggaucagagagaaccccuggauggaggacaagacccccguggagagcugggaggagauccccuaccugggcaagagagaggaccaguggugcggcagccugaucggccugaccagcagagccaccugggccaagaacauccaggccgccaucaaccaggugagaagccugaucggcaacgaggaguacaccgacuacaugcccagcaugaagagauucagaagagaggaggaggaggccggcgugcugugguga

SEQ ID NO: 17471 - RNA, 9876 nt, Artificial Sequence
  derived and/or modified CDS sequence (opt4) from DENV-2__EU482657__SS-prME
agcgccggcaugaucaucaugcugauccccaccgugauggccuuccaccugaccaccagaaacggcgagccccacaugaucgugggcauccaggagaagggcaagagccugcuguucaagaccgaggacggcgugaacaugugcacccugauggccauggaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgcccagagaaucgagaccuggaucaugagacaccccggcuucaccaucauggccgccauccuggccuacaccaucggcaccacccacuuccagagagugcugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaaggaggagcaggacaagagauucgugugcaagcacagcaugguggacagaggcuggggcaacggcugcggccuguucggcaagggcggcaucgugaccugcgccauguucaccugcaagaagaacauggagggcaagaucgugcagcccgagaaccuggaguacaccaucguggugaccccccacagcggcgaggagcacgccgugggcaacgacaccggcaagcacggcaaggagaucaaggugaccccccagagcagcaucaccgaggccgagcugaccggcuacggcaccgugaccauggagugcagccccagaaccggccuggacuucaacgagauggugcugcugcagauggagaacaaggccuggcuggugcacagacagugguuccuggaccugccccugcccuggcugcccggcgccgacaagcaggagagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucgugaucagagugcaguacgagggcgacggcagccccugcaagauccccuucgagaucauggaccuggagaagagauacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcaucgugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccaggaggagggcaucugcggcaucagaagcgugaccagacuggagaaccugauguggaagcagaucacccccgagcugaaccacauccuggccgagaacgaggugaagcugaccaucaugaccggcgacaucagaggcaucaugcaggccggcaagagaagccugagaccccagcccaccgagcugaaguacagcuggaagaccuggggcaaggccaagaugcugagcaccgagagcuacaaccagaccuuccugaucgacggccccgagaccgccgagugccccaacaccaacagagccuggaacagccuggagguggaggacuacggcuucggcguguucaccaccaacaucuggcugaagcugaaggagaagcaggacgccuucugcgacagcaagcugaugagcgccgccaucaaggacaacagagccgugcacgccgacaugggcuacuggauggagagcgcccugaacgacaccuggaagaucgagaaggccagcuucaucgaggugaagaacugccacuggcccaagagccacacccuguggagcaacggcgugcuggagagcgagaugaucauccccaagaaccuggccggccccgugagccagcacaacuacagacccggcuaccacacccagaucgccggccccuggcaccugggcaagcuggagauggacuucgacuucugcgacggcaccaccgugaucgugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagguggacaacuucagccugggcgugcugggcauggcccuguuccuggaggagaugcugagaaccagagugggcaccaagcacgccauccugcugguggccgugagcuucgugacccugaucaccggcaacaugagcuucaaggaccugggcagagugguggugauggugggcgccaccauggccgacgacaucggcaugggcgugaccuaccuggcccugcuggccgccuucaaggugagacccaccuucgccgccggccugcugcugagaaagcugaccagcaaggagcugaugaugaccaccaucggcaucgugcugcugagccagagcaccauccccgagaccgugcuggagcugaccgacgcccuggcccugggcaugauggugcugaagaucgugagaaacauggagaaguaccagcuggccgugaccaucauggccauccugugcgugcccaacgccgugauccugcagaacgccuggaaggugagcugcaccauccuggccguggugagcgugagcccccugcugcugaccagcagccagcagaagaccgacuggaucccccuggcccugaccaucaagggccugaaccccaccgccaucuuccugaccacccugagcagaaccaacaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccaccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggccuguuccccaucagcauccccaucaccgccgccgccugguaccugugggaggugaagaagcagagagccggcgugcugugggacgugcccagccccccccccaugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacaagggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucaucgacaagaagggcaagguggugggccuguacggcaacggcguggugaccagaagcggcgccuacgugagcgccaucgcccagaccgagaagagcaucgaggacaaccccgagaucgaggacgacaucuucagaaagagaagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucaucgacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaagauggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaagaccagagacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcagaggcaucggcaagaugacccugggcaugugcugcaucaucaccgccagcacccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucgccacccagcagcccgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggaccccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaucccccccgagaagugcgacacccugcugugcgacaucggcgagagcagccccaaccccaccguggaggccggcagaacccugagagugcugaaccugguggagaacuggcugaacaacaacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccagcggcaacaucgugagcagcgugaacaugaucagcagaaugcugaucaacagauucaccaugagacacaagaaggccaccuacgagcccgacguggaccugggcagcggcaccagaaacaucggcaucgagagcgagauccccaaccuggacaucaucggcaagagaaucgagaagaucaagcaggagcacgaggccagcuggcacuacgaccaggaccaccccuacaagaccugggccuaccacggcagcuacgagaccaagcagaccggcagcgccagcagcauggugaacggcguggugagacugcugaccaagcccugggacgugcugcccaccgugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcagauucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacauggagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcguguucaagaacauccagcaccugaccgugaccgaggagguggccgugcacaacuggcuggccagagugggcagagagagacugagcagaauggccaucagcggcgacgacugcguggugaagccccuggacgacagauucgccaacgcccugaccgcccugaacgacaugggcaagaucagaaaggacauccagcagugggagcccagcaagggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugagagagaccgccugccugggcaagagcuacgcccagauguggagccugauguacuuccacagaagagaccugagacuggccgccaacgccaucugcagcgccgugcccagccacugggugcccaccagcagaaccaccuggagcauccacgccaagcacgaguggaugaccaccgaggacaugcugaccguguggaacagaguguggaucagagagaaccccuggauggaggacaagacccccguggagagcugggaggagauccccuaccugggcaagagagaggaccaguggugcggcagccugaucggccugaccagcagagccaccugggccaagaacauccaggccgccaucaaccaggugagaagccugaucggcaacgaggaguacaccgacuacaugcccagcaugaagagauucagaagagaggaggaggaggccggcgugcugugguga

SEQ ID NO: 17472 - RNA, 9876 nt, Artificial Sequence
  derived and/or modified CDS sequence (opt4) from DENV-2__EU482658__SS-prME
agcgccggcaugaucaucaugcugauccccaccgugauggccuuccaccugaccaccagaaacggcgagccccacaugaucgugggcauccaggagaagggcaagagccugcuguucaagaccgaggacggcgugaacaugugcacccugauggccauggaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgcccagagaaucgagaccuggauccugagacaccccggcuucaccaucauggccgccauccuggccuacaccaucggcaccacccacuuccagagagugcugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaaggaggagcaggacaagagauucgugugcaagcacagcaugguggacagaggcuggggcaacggcugcggccuguucggcaagggcggcaucgugaccugcgccauguucaccugcaagaagaacauggagggcaagaucgugcagcccgagaaccuggaguacaccaucguggugaccccccacagcggcgaggagcacgccgugggcaacgacaccggcaagcacggcaaggagaucaaggugaccccccagagcagcaucaccgaggccgagcugaccggcuacggcaccgugaccauggagugcagccccagaaccggccuggacuucaacgagauggugcugcugcagauggagaacaaggccuggcuggugcacagacagugguuccuggaccugccccugcccuggcugcccggcgccgacaagcaggagagcaacuggauccagaaggagacccuggugaccuucaagaacccccacgccaagaagcaggacgugaucgugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucgugaucagagugcaguacgagggcgacggcagccccugcaagauccccuucgagaucauggaccuggagaagagauacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcaucgugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccaggaggagggcaucugcggcaucagaagcgugaccagacuggagaaccugauguggaagcagaucacccccgagcugaaccacauccuggccgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagcuacaaccagaccuuccugaucgacggccccgagaccaccgagugccccaacaccaacagagccuggaacagccuggagguggaggacuacggcuucggcguguucaccaccaacaucuggcugaagcugaaggagaagcaggacgccuucugcgacagcaagcugaugagcgccgccaucaaggacaacagagccgugcacgccgacaugggcuacuggaucgagagcgcccugaacgacaccuggaagaucgagaaggccagcuucaucgaggugaagaacugccacuggcccaagagccacacccuguggagcaacggcgugcuggagagcgagaugaucauccccaagaaccuggccggccccgugagccagcacaacuacagacccggcuaccacacccagaucgccggccccuggcaccugggcaagcuggagauggacuucgacuucugcgacggcaccaccgugaucgugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagguggacaacuucagccugggcgugcugggcauggcccuguuccuggaggagaugcugagaaccagagugggcaccaagcacgccauccugcuggugaccgugagcuucgugacccugaucaccggcaacaugagcuucaaggaccugggcagagugguggugauggugggcgccaccauggccgacgacaucggcaugggcgugaccuaccuggcccugcuggccgccuucaaggugagacccaccuucgccgccggccugcugcugagaaagcugaccagcaaggagcugaugaugaccaccaucggcaucgugcugcugagccagagcaccauccccgagaccgugcuggagcugaccgacgcccuggcccugggcaugauggugcugaagaucgugagaaacauggagaaguaccagcuggccgugaccaucauggccauccugugcgugcccaacgccgugauccugcagaacgccuggaaggugagcugcaccauccuggccguggugagcgugagcccccugcugcugaccagcagccagcagaagaccgacuggaucccccuggcccugaccaucaagggccugaaccccaccgccaucuuccugaccacccugagcagaaccaacaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccaccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggccuguuccccaucagcauccccaucaccgccgccgccugguaccugugggaggugaagaagcagagagccggcgugcugugggacgugcccagccccccccccaugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacaagggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucaucgacaagaagggcaagguggugggccuguacggcaacggcguggugaccagaagcggcgccuacgugagcgccaucgcccagaccgagaagagcaucgaggacaaccccgagaucgaggacgacaucuucagaaagagaagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucaucgacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaagauggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaagaccagagacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcagaggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucgccacccagcagcccgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggaccccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaucccccccgagaagugcgacacccugcugugcgacaucggcgagagcagccccaaccccaccguggaggccggcagaacccugagagugcugaaccugguggagaacuggcugaacaacaacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccagcggcaacaucgugagcagcgugaacaugaucagcagaaugcugaucaacagauucaccaugagacacaagaaggccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacgugcugcccaccgugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcagauucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacauggagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcguguucaagaacauccagcaccugaccgugaccgaggagguggccgugcagaacuggcuggccagagugggcagagagagacugagcagaauggccaucagcggcgacgacugcguggugaagccccuggacgacagauucgccaacgcccugaccgcccugaacgacaugggcaagaucagaaaggacauccagcagugggagcccagcaagggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugagagagaccgccugccugggcaagagcuacgcccagauguggagccugauguacuuccacagaagagaccugagacuggccgccaacgccaucugcagcgccgugcccagccacugggugcccaccagcagaaccaccuggagcauccacgccaagcacgaguggaugaccaccgaggacaugcugaccguguggaacagaguguggaucagagacaaccccuggauggaggacaagacccccguggagagcugggaggagauccccuaccugggcaagagagaggaccaguggugcggcagccugaucggccugaccagcagagccaccugggccaagaacauccaggccgccaucaaccaggugagaagccugaucggcaacgaggaguacaccgacuacaugcccagcaugaagagauucagaagagaggaggaggaggccggcgugcugugguga

SEQ ID NO: 17473 - RNA, 9876 nt, Artificial Sequence
  derived and/or modified CDS sequence (opt4) from DENV-2__EU482659__SS-prME
agcgccggcaugaucaucaugcugauccccaccgugauggccuuccaccugaccaccagaaacggcgagccccacaugaucgugggcauccaggagaagggcaagagccugcuguucaagaccgaggacggcgugaacaugugcacccugauggccauggaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgcccagagaaucgagaccuggauccugagacaccccggcuucaccaucauggccgccauccuggccuacaccaucggcaccacccacuuccagagagugcugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaaggaggagcaggacaagagauucgugugcaagcacagcaugguggacagaggcuggggcaacggcugcggccuguucggcaagggcggcaucgugaccugcgccauguucaccugcaagaagaacauggagggcaagaucgugcagcccgagaaccuggaguacaccaucguggugaccccccacagcggcgaggagcacgccgugggcaacgacaccggcaagcacggcaaggagaucaaggugaccccccagagcagcaucaccgaggccgagcugaccggcuacggcaccgugaccauggagugcagccccagaaccggccuggacuucaacgagauggugcugcugcagauggagaacaaggccuggcuggugcacagacagugguuccuggaccugccccugcccuggcugcccggcgccgacaagcaggagagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucgugaucagagugcaguacgagggcgacggcagccccugcaagauccccuucgagaucauggaccuggagaagagauacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcaucgugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccaggaggagggcaucugcggcaucagaagcgugaccagacuggagaaccugauguggaagcagaucacccccgagcugaaccacauccuggccgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagcuacaaccagaccuuccugaucgacggccccgagaccaccgagugccccaacaccaacagagccuggaacagccuggagguggaggacuacggcuucggcguguucaccaccaacaucuggcugaagcugaaggagaagcaggacgccuucugcgacagcaagcugaugagcgccgccaucaaggacaacagagccgugcacgccgacaugggcuacuggaucgagagcgcccugaacgacaccuggaagaucgagaaggccagcuucaucgaggugaagaacugccacuggcccaagagccacacccuguggagcaacggcgugcuggagagcgagaugaucauccccaagaaccuggccggccccgugagccagcacaacuacagacccggcuaccacacccagaucgccggccccuggcaccugggcaagcuggagauggacuucgacuucugcgacggcaccaccgugaucgugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagguggacaacuucagccugggcgugcugggcauggcccuguuccuggaggagaugcugagaaccagagugggcaccaagcacgccauccugcugguggccgugagcuucgugacccugaucaccggcaacaugagcuucaaggaccugggcagagugguggugauggugggcgccaccauggccgacgacaucggcaugggcgugaccuaccuggcccugcuggccgccuucaaggugagacccaccuucgccgccggccugcugcugagaaagcugaccagcaaggagcugaugaugaccaccaucggcaucgugcugcugagccagagcaccauccccgagaccgugcuggagcugaccgacgcccuggcccugggcaugauggugcugaagaucgugagaaacauggagaaguaccagcuggccgugaccaucauggccauccugugcgugcccaacgccgugauccugcagaacgccuggaaggugagcugcaccauccuggccguggugagcgugagcccccugcugcugaccagcagccagcagaagaccgacuggaucccccuggcccugaccaucaagggccugaaccccaccgccaucuuccugaccacccugagcagaaccaacaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccaccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggccuguuccccaucagcauccccaucaccgccgccgccugguaccugugggaggugaagaagcagagagccggcgugcugugggacgugcccagccccccccccaugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacaagggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucaucgacaagaagggcaagguggugggccuguacggcaacggcguggugaccagaagcggcgccuacgugagcgccaucgcccagaccgagaagagcaucgaggacaaccccgagaucgaggacgacaucuucagaaagagaagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucaucgacgaggagagagagauccccgagagaagcuggaacaccggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaagauggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaagaccagagacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcagaggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucgccacccagcagcccgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggaccccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaucccccccgagaagugcgacacccugcugugcgacaucggcgagagcagccccaaccccaccguggaggccggcagaacccugagagugcugaaccugguggagaacuggcugaacaacaacacccaguucugcaucaaggugcugaaccccuacaugcccagcgugaucgagaagauggaggcccugcagagaaagcacggcggcgcccuggugagaaacccccugagcagaaacagcacccacgagauguacugggugagcaacgccagcggcaacaucgugagcagcgugaacaugaucagcagaaugcugaucaacagauucaccaugagacacaagaaggccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacgugcugcccaccgugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcagauucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacauggagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcguguucaagaacauccagcaccugaccgugaccgaggagguggccgugcagaacuggcuggccagagugggcagagagagacugagcagaauggccaucagcggcgacgacugcguggugaagccccuggacgacagauucgccaacgcccugaccgcccugaacgacaugggcaagaucagaaaggacauccagcagugggagcccagcaagggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugagagagaccgccugccugggcaagagcuacgcccagauguggagccugauguacuuccacagaagagaccugagacuggccgccaacgccaucugcagcgccgugcccagccacugggugcccaccagcagaaccaccuggagcauccacgccaagcacgaguggaugaccaccgaggacaugcugaccguguggaacagaguguggaucagagagaaccccuggauggaggacaagacccccguggagagcugggaggagauccccuaccugggcaagagagaggaccaguggugcggcagccugaucggccugaccagcagagccaccugggccaagaacauccaggccgccaucaaccaggugagaagccugaucggcgacgaggaguacaccgacuacaugcccagcaugaagagauucagaagagaggaggaggaggccggcgugcugugguga

SEQ ID NO: 17474 - RNA, 9876 nt, Artificial Sequence
  derived and/or modified CDS sequence (opt4) from DENV-2__EU482661__SS-prME
agcgccggcaugaucaucaugcugauccccaccgugauggccuuccaccugaccaccagaaacggcgagccccacaugaucgugggcauccaggagaagggcaagagccugcuguucaagaccgaggacggcgugaacaugugcacccugauggccauggaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgcccagagaaucgagaccuggauccugagacaccccggcuucaccaucauggccgccauccuggccuacaccaucggcaccacccacuuccagagagugcugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaaggaggagcaggacaagagauucgugugcaagcacagcaugguggacagaggcuggggcaacggcugcggccuguucggcaagggcggcaucgugaccugcgccauguucaccugcaagaagaacauggagggcaagaucgugcagcccgagaaccuggaguacaccaucguggugaccccccacagcggcgaggagcacgccgugggcaacgacaccggcaagcacggcaaggagaucaaggugaccccccagagcagcaucaccgaggccgagcugaccggcuacggcaccgugaccauggagugcagccccagaaccggccuggacuucaacgagauggugcugcugcagauggagaacaaggccuggcuggugcacagacagugguuccuggaccugccccugcccuggcugcccggcgccgacaagcaggagagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucgugaucagagugcaguacgagggcgacggcagccccugcaagauccccuucgagaucauggaccuggagaagagauacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcaucgugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccaggaggagggcaucugcggcaucagaagcgugaccagacuggagaaccugauguggaagcagaucacccccgagcugaaccacauccuggccgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagcuacaaccagaccuuccugaucgacggccccgagaccgccgagugccccaacaccaacagagccuggaacagccuggagguggaggacuacggcuucggcguguucaccaccaacaucuggcugaagcugaaggagaagcaggacgccuucugcgacagcaagcugaugagcgccgccaucaaggacaacagagccgugcacgccgacaugggcuacuggaucgagagcgcccugaacgacaccuggaagaucgagaaggccagcuucaucgaggugaagaacugccacuggcccaagagccacacccuguggagcaacggcgugcuggagagcgagaugaucauccccaagaaccuggccggccccgugagccagcacaacuacagacccggcuaccacacccagaucgccggccccuggcaccugggcaagcuggagauggacuucgacuucugcgacggcaccaccgugaucgugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagguggacaacuucagccugggcgugcugggcauggcccuguuccuggaggagaugcugagaaccagagugggcaccaagcacgccauccugcugguggccgugagcuucgugacccugaucaccggcaacaugagcuucaaggaccugggcagagugguggugauggugggcgccaccauggccgacgacaucggcaugggcgugaccuaccuggcccugcuggccgccuucaaggugagacccaccuucgccgccggccugcugcugagaaagcugaccagcaaggagcugaugaugaccaccaucggcaucgugcugcugagccagagcaccauccccgagaccgugcuggagcugaccgacgcccuggcccugggcaugauggugcugaagaucgugagaaacauggagaaguaccagcuggccgugaccaucauggccauccugugcgugcccaacgccgugauccugcagaacgccuggaaggugagcugcaccauccuggccguggugagcgugagcccccugcugcugaccagcagccagcagaagaccgacuggaucccccuggcccugaccaucaagggccugaaccccaccgccaucuuccugaccacccugagcagaaccaacaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccaccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggccuguuccccaucagcauccccaucaccgccgccgccugguaccugugggaggugaagaagcagagagccggcgugcugugggacgugcccagccccccccccaugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacaagggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucaucgacaagaagggcaagguggugggccuguacggcaacggcguggugaccagaagcggcgccuacgugagcgccaucgcccagaccgagaagagcaucgaggacaaccccgagaucgagggcgacaucuucagaaagagaagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucaucgacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaagauggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaagaccagagacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcagaggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucgccacccagcagcccgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggaccccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaucccccccgagaagugcgacacccugcugugcgacaucggcgagagcagccccaaccccaccguggaggccggcagaacccugagagugcugaaccugguggagaacuggcugaacaacaacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccagcggcaacaucgugagcagcgugaacaugaucagcagaaugcugaucaacagauucaccaugagacacaagaaggccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacgugcugcccaccgugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcagauucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacauggagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcguguucaagaacauccagcaccugaccgugaccgaggagguggccgugcagaacuggcuggccagagugggcagagagagacugagcagaauggccaucagcggcgacgacugcguggugaagccccuggacgacagauucgccaacgcccugaccgcccugaacgacaugggcaagaucagaaaggacauccagcagugggagcccagcaagggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugagagagaccgccugccugggcaagagcuacgcccagauguggagccugauguacuuccacagaagagaccugagacuggccgccaacgccaucugcagcgccgugcccagccacugggugcccaccagcagaaccaccuggagcauccacgccaagcacgaguggaugaccaccgaggacaugcugaccguguggaacagaguguggaucagagagaaccccuggauggaggacaagacccccguggagagcugggaggagauccccuaccugggcaagagagaggaccaguggugcggcagccugaucggccugaccagcagagccaccugggccaagaacauccaggccgccaucaaccaggugagaagccugaucggcaacgaggaguacaccgacuacaugcccagcaugaagagauucagaagagaggaggaggaggccggcgugcugugguga

SEQ ID NO: 17475 - RNA, 9876 nt, Artificial Sequence
  derived and/or modified CDS sequence (opt4) from DENV-2__EU482662__SS-prME
accgccggcgugaucaucaugcugauccccaccgccauggccuuccaccugaccaccagaaacggcgagccccacaugaucgugggcagacaggagaagggcaagagccugcuguucaagaccgaggacggcgugaacaugugcacccugauggccaucgaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgcccagagaaucgagaccuggauccugagacaccccggcuucaccaucauggccgccauccuggccuacaccaucggcaccacccacuuccagaaggcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaacgaggagcaggacaagagauucgugugcaagcacagcaugguggacagaggcuggggcaacggcugcggccuguucggcaagggcggcaucgugaccugcgccauguucaccugcaagaagaacauggagggcaagaucgugcagcccgagaaccuggaguacaccaucgugaucaccccccacagcggcgaggagcacgccgugggcaacgacaccggcaagcacggcaaggagaucaagaucaccccccagagcagcaucaccgaggccgagcugaccggcuacggcaccgugaccauggagugcagccccagaaccggccuggacuucaacgagauggugcugcugcagauggaggacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagaucgugaaggagaucgccgagacccagcacggcaccaucgugaucagagugcaguacgagggcgacggcagccccugcaagauccccuucgagaucauggaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgccaucaucaccuggaucggcaugaacagcagaagcaccagccugagcgugagccuggugcuggugggcgugaucacccuguaccugggcgccauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucaccaccaacaucuggcugaagcugagagagaagcaggacguguucugcgacagcaagcugaugagcgccgccaucaaggacaacagagccgugcacgccgacaugggcuacuggaucgagagcgcccugaacgacaccuggaagauggagaaggccagcuucaucgaggugaagagcugccacuggcccaagagccacacccuguggagcaacggcgugcuggagagcgagaugaucauccccaagagcuucgccggccccgugagccagcacaacuacagacccggcuacuacacccagaccgccggccccuggcaccugggcaagcuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugguggccgugagcuucaugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugauggccaccaucggcaucgcccugcugagccagagcaccauccccgagaccauccuggagcugaccgacgcccuggcccugggcaugauggugcugaagaucgugagaaacauggagaaguaccagcuggccgugaccaucauggccaucagcugcgugcccaacgccgugauccugcagaacgccuggaaggugagcugcaccauccuggccgccgugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccaccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggccuguuccccgugagcauccccaucaccgccgccgccugguaccugugggaggugaagaagcagagagccggcgugcugugggacgugcccagccccccccccgugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacagaggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucguggacagaaagggcaagguggugggccuguacggcaacggcguggugaccagaagcggcgccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucaucgacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacagaguggccgccgagggcaucaacuacgccgacagaagauggugcuucgacggcgugaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagagacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcgugggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucgccacccaggagcccgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugaucgcccacuacgccaucaucggccccggccugcaggccaaggccaccagagaggcccagaagagagccgccgccggcaucaugaagaaccccaccguggacggcaucaccgugaucgaccuggaccccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccaucgaggccggcagaacccugagagugcugagccugguggagaacuggcugaacaacgacacccaguucugcaucaaggugcugaaccccuacaugcccagcgugaucgagaagauggagacccugcagagaaaguacggcggcgcccuggugagaaacccccugagcagaaacagcacccacgagauguacugggugagcaacgccaccggcaacaucgugagcagcgugaacaugaucagcagaaugcugaucaacagauucaccaugaagcacaagaaggccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacguggugcccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcagauucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacauggagggcgagcacaagagacuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcaucuucaagagcauccagcaccugaccgugaccgaggagaucgccgugcagaacuggcuggccagagugggcagagagagacugagcagaauggccaucagcggcgacgacugcguggugaagccccuggacgacagauucgccagcgcccugaccgcccugaacgacaugggcaaggugagaaaggacauccagcagugggagcccagcaagggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugaaggagaccgccugccugggcaagagcuacgcccagauguggagccugauguacuuccacagaagagaccugagacuggccgccaacgccaucugcagcgccgugcccagccacugggugcccaccagcagaaccaccuggagcauccacgccaagcacgaguggaugaccaccgaggacaugcugaccguguggaacagaguguggauccaggagaaccccuggauggaggacaagacccccguggagagcugggaggaggugcccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 17476 - RNA, 9876 nt, Artificial Sequence
  derived and/or modified CDS sequence (opt4) from DENV-2__EU482663__SS-prME
agcgccggcaugaucaucaugcugauccccaccgugauggccuuccaccugaccaccagaaacggcgagccccacaugaucgugggcauccaggagaagggcaagagccugcuguucaagaccgaggacggcgugaacaugugcacccugauggccauggaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgcccagagaaucgagaccuggauccugagacaccccggcuucaccaucauggccgccauccuggccuacaccaucggcaccacccacuuccagagagugcugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaaggaggagcaggacaagagauucgugugcaagcacagcaugguggacagaggcuggggcaacggcugcggccuguucggcaagggcggcaucgugaccugcgccauguucaccugcaagaagaacauggagggcaagaucgugcagcccgagaaccuggaguacaccaucguggugaccccccacagcggcgaggagcacgccgugggcaacgacaccggcaagcacggcaaggagaucaaggugaccccccagagcagcaucaccgaggccgagcugaccggcuacggcaccgugaccauggagugcagccccagaaccggccuggacuucaacgagauggugcugcugcagauggagaacaaggccuggcuggugcacagacagugguuccuggaccugccccugcccuggcugcccggcgccgacaagcaggagagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucgugaucagagugcaguacgagggcgacggcagccccugcaagauccccuucgagaucauggaccuggagaagagauacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcaucgugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccaggaggagggcaucugcggcaucagaagcgugaccagacuggagaaccugauguggaagcagaucacccccgagcugaaccacauccuggccgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagcuacaaccagaccuuccugaucgacggccccgagaccgccgagugccccaacaccaacagagccuggaacagccuggagguggaggacuacggcuucggcguguucaccaccaacaucuggcugaagcugaaggagaagcaggacguguucugcgacagcaagcugaugagcgccgccaucaaggacaacagagccgugcacgccgacaugggcuacuggaucgagagcgcccugaacgacaccuggaagaucgagaaggccagcuucaucgaggugaagaacugccacuggcccaagagccacacccuguggagcaacggcgugcuggagagcgagaugaucauccccaagaaccuggccggccccgugagccagcacaacuacagacccggcuaccacacccagaucgccggccccuggcaccugggcaagcuggagauggacuucgacuucugcgacggcaccaccgugaucgugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagguggacaacuucagccugggcgugcugggcauggcccuguuccuggaggagaugcugagaaccagagugggcaccaagcacgccauccugcugguggccgugagcuucgugacccugaucaccggcaacaugagcuucaaggaccugggcagagugguggugauggugggcgccaccauggccgacgacaucggcaugggcgugaccuaccuggcccugcuggccgccuucaaggugagacccaccuucgccgccggccugcugcugagaaagcugaccagcaaggagcugaugaugaccaccaucggcaucgugcugcugagccagagcaccauccccgagaccgugcuggagcugaccgacgcccuggcccugggcaugauggugcugaagaucgugagaaacauggagaaguaccagcuggccgugaccaucauggccauccugugcgugcccaacgccgugauccugcagaacgccuggaaggugagcugcaccauccuggccguggugagcgugagcccccugcugcugaccagcagccagcagaagaccgacuggaucccccuggcccugaccaucaagggccugaaccccaccgccaucuuccugaccacccugagcagaaccaacaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccaccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggccuguuccccaucagcauccccaucaccgccgccgccugguaccugugggaggugaagaagcagagagccggcgugcugugggacgugcccagccccccccccaugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacaagggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucaucgacaagaagggcaagguggugggccuguacggcaacggcguggugaccagaagcggcgccuacgugagcgccaucgcccagaccgagaagagcaucgaggacaaccccgagaucgaggacgacaucuucagaaagagaagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucaucgacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaagauggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaagaccagagacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcagaggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggacuucggccugggcagcaucgccacccagcagcccgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggaccccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugagaaacgugagagaggugaagggccugaccaagggcggccccggccacgaggagcccauccccaugagcaccuacggcuggaaccuggugagacugcagagcggcguggacguguucuucaucccccccgagaagugcgacacccugcugugcgacaucggcgagagcagccccaaccccaccguggaggccggcagaacccugagagugcugaaccugguggagaacuggcugaacaacaacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccagcggcaacaucgugagcagcgugaacaugaucagcagaaugcugaucaacagauucaccaugagacacaagaaggccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacgugcugcccaccgugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcagauucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacauggagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcguguucaagaacauccagcaccugaccgugaccgaggagguggccgugcagaacuggcuggccagagugggcagagagagacugagcagaauggccaucagcggcgacgacugcguggugaagccccuggacgacagauucgccaacgcccugaccgcccugaacgacaugggcaagaucagaaaggacauccagcagugggagcccagcaagggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugagagagaccgccugccugggcaagagcuacgcccagauguggagccugauguacuuccacagaagagaccugagacuggccgccaacgccaucugcagcgccgugcccagccacugggugcccaccagcagaaccaccuggagcauccacgccaagcacgaguggaugaccaccgaggacaugcugaccguguggaacagaguguggaucagagagaaccccuggauggaggacaagacccccguggagagcugggaggagauccccuaccugggcaagagagaggaccaguggugcggcagccugaucggccugaccagcagagccaccugggccaagaacauccaggccgccaucaaccaggugagaagccugaucggcaacgaggaguacaucgacuacaugcccagcaugaagagauucagaagagaggaggaggaggccggcgugcugugguga

SEQ ID NO: 17477 - RNA, 9876 nt, Artificial Sequence
  derived and/or modified CDS sequence (opt4) from DENV-2__EU482664__SS-prME
accgccggcgugaucaucaugcugauccccaccgccauggccuuccaccugaccaccagaaacggcgagccccacaugaucgugggcagacaggagaagggcaagagccugcuguucaagaccgaggacggcgugaacaugugcacccugauggccaucgaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgcccagagaaucgagaccuggauccugagacaccccggcuucaccaucauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaacgaggagcaggacaagagauucgugugcaagcacagcaugguggacagaggcuggggcaacggcugcggccuguucggcaagggcggcaucgugaccugcgccauguucaccugcaagaagaacauggagggcaagaucgugcagcccgagaaccuggaguacaccaucgugaucaccccccacagcggcgaggagcacgccgugggcaacgacaccggcaagcacggcaaggagaucaagaucaccccccagagcagcaucaccgaggccgagcugaccggcuacggcaccgugaccauggagugcagccccagaaccggccuggacuucaacgagauggugcugcugcagauggaggacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagaucgugaaggagaucgccgagacccagcacggcaccaucgugaucagagugcaguacgagggcgacggcagccccugcaagauccccuucgagaucauggaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgccaucaucaccuggaucggcaugaacagcagaagcaccagccugagcgugagccuggugcuggugggcgugaucacccuguaccugggcgccauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucaccaccaacaucuggcugaagcugagagagaagcaggacguguucugcgacagcaagcugaugagcgccgccaucaaggacaacagagccgugcacgccgacaugggcuacuggaucgagagcgcccugaacgacaccuggaagauggagaaggccagcuucaucgaggugaagagcugccacuggcccaagagccacacccuguggagcaacggcgugcuggagagcgagaugaucauccccaagagcuucgccggccccgugagccagcacaacuacagacccggcuacuacacccagaccgccggccccuggcaccugggcaagcuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugauggccaccaucggcaucgcccugcugagccagagcaccauccccgagaccauccuggagcugaccgacgcccuggcccugggcaugauggugcugaagaucgugagaaacauggagaaguaccagcuggccgugaccaucauggccaucagcugcgugcccaacgccgugauccugcagaacgccuggaaggugagcugcaccauccuggccgccgugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccaccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggccuguuccccgugagcauccccaucaccgccgccgccugguaccugugggaggugaagaagcagagagccggcgugcugugggacgugcccagccccccccccgugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacagaggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucguggacagaaagggcaagguggugggccuguacggcaacggcguggugaccagaagcggcgccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucaucgacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacagaguggccgccgagggcaucaacuacgccgacagaagauggugcuucgacggcgugaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagagacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcgugggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcguggccacccaggagcccgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugaucgcccacuacgccaucaucggccccggccugcaggccaaggccaccagagaggcccagaagagagccgccgccggcaucaugaagaaccccaccguggacggcaucaccgugaucgaccuggaccccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccaucgaggccggcagaacccugagagugcugagccugguggagaacuggcugaacaacgacacccaguucugcaucaaggugcugaaccccuacaugcccagcgugaucgagaagauggagacccugcagagaaaguacggcggcgcccuggugagaaacccccugagcagaaacagcacccacgagauguacugggugagcaacgccaccggcaacaucgugagcagcgugaacaugaucagcagaaugcugaucaacagauucaccaugaagcacaagaaggccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacguggugcccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcagauucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacauggagggcgagcacaagagacuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcaucuucaagagcauccagcaccugaccgugaccgaggagaucgccgugcagaacuggcuggccagagugggcagagagagacugagcagaauggccaucagcggcgacgacugcguggugaagccccuggacgacagauucgccagcgcccugaccgcccugaacgacaugggcaaggugagaaaggacauccagcagugggagcccagcaagggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugaaggagaccgccugccugggcaagagcuacgcccagauguggagccugauguacuuccacagaagagaccugagacuggccgccaacgccaucugcagcgccgugcccagccacugggugcccaccagcagaaccaccuggagcauccacgccaagcacgaguggaugaccaccgaggacaugcugaccguguggaacagaguguggauccaggagaaccccuggauggaggacaagacccccguggagagcugggaggaggugcccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 17478 - RNA, 9876 nt, Artificial Sequence
  derived and/or modified CDS sequence (opt4) from DENV-2__EU482665__SS-prME
agcgccggcaugaucaucaugcugauccccaccgugauggccuuccaccugaccaccagaaacggcgagccccacaugaucgugggcauccaggagaagggcaagagccugcuguucaagaccgaggacggcgugaacaugugcacccugauggccauggaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgcccagagaaucgagaccuggauccugagacaccccggcuucaccaucauggccgccauccuggccuacaccaucggcaccacccacuuccagagagugcugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaaggaggagcaggacaagagauucgugugcaagcacagcaugguggacagaggcuggggcaacggcugcggccuguucggcaagggcggcaucgugaccugcgccauguucaccugcaagaagaacauggagggcaagaucgugcagcccgagaaccuggaguacaccaucguggugaccccccacagcggcgaggagcacgccgugggcaacgacaccggcaagcacggcaaggagaucaaggugaccccccagagcagcaucaccgaggccgagcugaccggcuacggcaccgugaccauggagugcagccccagaaccggccuggacuucaacgagauggugcugcugcagauggagaacaaggccuggcuggugcacagacagugguuccuggaccugccccugcccuggcugcccggcgccgacaagcaggagagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucgugaucagagugcaguacgagggcgacggcagccccugcaagauccccuucgagaucauggaccuggagaagagauacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcaucgugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccaggaggagggcaucugcggcaucagaagcgugaccagacuggagaaccugauguggaagcagaucacccccgagcugaaccacauccuggccgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagcuacaaccagaccuuccugaucgacggccccgagaccgccgagugccccaacaccaacagagccuggaacagccuggagguggaggacuacggcuucggcguguucaccaccaacaucuggcugaagcugaaggagaagcaggacgccuucugcgacagcaagcugaugagcgccgccaucaaggacaacagagccgugcacgccgacaugggcuacuggaucgagagcgcccugaacgacaccuggaagaucgagaaggccagcuucaucgaggugaagaacugccacuggcccaagagccacacccuguggagcaacggcgugcuggagagcgagaugaucauccccaagaaccuggccggccccgugagccagcacaacuacagacccggcuaccacacccagaucgccggccccuggcaccugggcaagcuggagauggacuucgacuucugcgacggcaccaccgugaucgugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagguggacaacuucagccugggcgugcugggcauggcccuguuccuggaggagaugcugagaaccagagugggcaccaagcacgccauccugcugguggccgugagcuucgugacccugaucaccggcaacaugagcuucaaggaccugggcagagugguggugauggugggcgccaccauggccgacgacaucggcaugggcgugaccuaccuggcccugcuggccgccuucaaggugagacccaccuucgccgccggccugcugcugagaaagcugaccagcaaggagcugaugaugaccaccaucggcaucgugcugcugagccagagcaccauccccgagaccgugcuggagcugaccgacgcccuggcccugggcaugauggugcugaagaucgugagaaacauggagaaguaccagcuggccgugaccaucauggccauccugugcgugcccaacgccgugauccugcagaacgccuggaaggugagcugcaccauccuggccguggugagcgugagcccccugcugcugaccagcagccagcagaagaccgacuggaucccccuggcccugaccaucaagggccugaaccccaccgccaucuuccugaccacccugagcagaaccaacaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccaccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggccuguuccccaucagcauccccaucaccgccgccgccugguaccugugggaggugaagaagcagagagccggcgugcugugggacgugcccagccccccccccaugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacaagggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucaucgacaagaagggcaagguggugggccuguacggcaacggcguggugaccagaagcggcgccuacgugagcgccaucgcccagaccgagaagagcaucgaggacaaccccgagaucgaggacgacaucuucagaaagagaagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucaucgacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaagauggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaagaccagagacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcagaggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggacuucggccugggcagcaucgccacccagcagcccgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggaccccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaucccccccgagaagugcgacacccugcugugcgacaucggcgagagcagccccaaccccaccguggaggccggcagaacccugagagugcugaaccugguggagaacuggcugaacaacaacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccagcggcaacaucgugagcagcgugaacaugaucagcagaaugcugaucaacagauucaccaugagacacaagaaggccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacgugcugcccaccgugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcagauucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacauggagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcguguucaagaacauccagcaccugaccgugaccgaggagguggccgugcagaacuggcuggccagagugggcagagagagacugagcagaauggccaucagcggcgacgacugcguggugaagccccuggacgacagauucgccaacgcccugaccgcccugaacgacaugggcaagaucagaaaggacauccagcagugggagcccagcaagggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugagagagaccgccugccugggcaagagcuacgcccagauguggagccugauguacuuccacagaagagaccugagacuggccgccaacgccaucugcagcgccgugcccagccacugggugcccaccagcagaaccaccuggagcauccacgccaagcacgaguggaugaccaccgaggacaugcugaccguguggaacagaguguggaucagagagaaccccuggauggaggacaagacccccguggagagcugggaggagauccccuaccugggcaagagagaggaccaguggugcggcagccugaucggccugaccagcagagccaccugggccaagaacauccaggccgccaucaaccaggugagaagccugaucggcaacgaggaguacaccgacuacaugcccagcaugaagagauucagaagagaggaggaggaggccggcgugcugugguga

SEQ ID NO: 17479 - RNA, 9876 nt, Artificial Sequence
  derived and/or modified CDS sequence (opt4) from DENV-2__EU482666__SS-prME
accgccggcgugaucaucaugcugauccccaccgccauggccuuccaccugaccaccagaaacggcgagccccacaugaucgugggcagacaggagaagggcaagagccugcuguucaagaccgaggacggcgugaacaugugcacccugauggccaucgaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgcccagagaaucgagaccuggauccugagacaccccggcuucaccaucauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaacgaggagcaggacaagagauucgugugcaagcacagcaugguggacagaggcuggggcaacggcugcggccuguucggcaagggcggcaucgugaccugcgccauguucaccugcaagaagaacauggagggcaagaucgugcagcccgagaaccuggaguacaccaucgugaucaccccccacagcggcgaggagcacgccgugggcaacgacaccggcaagcacggcaaggagaucaagaucaccccccagagcagcaucaccgaggccgagcugaccggcuacggcaccgugaccauggagugcagccccagaaccggccuggacuucaacgagauggugcugcugcagauggaggacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagaucgugaaggagaucgccgagacccagcacggcaccaucgugaucagagugcaguacgagggcgacggcagccccugcaagauccccuucgagaucauggaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgccaucaucaccuggaucggcaugaacagcagaagcaccagccugagcgugagccuggugcuggugggcgugaucacccuguaccugggcgccauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucaccaccaacaucuggcugaagcugagagagaagcaggacguguucugcgacagcaagcugaugagcgccgccaucaaggacaacagagccgugcacgccgacaugggcuacuggaucgagagcgcccugaacgacaccuggaagauggagaaggccagcuucaucgaggugaagagcugccacuggcccaagagccacacccuguggagcaacggcgugcuggagagcgagaugaucauccccaagagcuucgccggccccgugagccagcacaacuacagacccggcuaccacacccagaccgccggccccuggcaccugggcaagcuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugguggccgugagcuucaugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugauggccaccaucggcaucgcccugcugagccagagcaccauccccgagaccauccuggagcugaccgacgcccuggcccugggcaugauggugcugaagaucaugagaaacauggagaaguaccagcuggccgugaccaucauggccaucagcugcgugcccaacgccgugauccugcagaacgccuggaaggugagcugcaccauccuggccgccgugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccaccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggccuguuccccgugagcauccccaucaccgccgccgccugguaccugugggaggugaagaagcagagagccggcgugcugugggacgugcccagccccccccccgugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacagaggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucguggacagaaagggcaagguggugggccuguacggcaacggcguggugaccagaagcggcgccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucaucgacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacagaguggccgccgagggcaucaacuacgccgacagaagauggugcuucgacggcgugaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagagacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcgugggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucgccacccaggagcccgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugaucgcccacuacgccaucaucggccccggccugcaggccaaggccaccagagaggcccagaagagagccgccgccggcaucaugaagaaccccaccguggacggcaucaccgugaucgaccuggaccccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccaucgaggccggcagaacccugagagugcugagccugguggagaacuggcugaacaacgacacccaguucugcaucaaggugcugaaccccuacaugcccagcgugaucgagaagauggagacccugcagagaaaguacggcggcgcccuggugagaaacccccugagcagaaacagcacccacgagauguacugggugagcaacgccaccggcaacaucgugagcagcgugaacaugaucagcagaaugcugaucaacagauucaccaugaagcacaagaaggccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacguggugcccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcagauucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacauggagggcgagcacaagagacuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcaucuucaagagcauccagcaccugaccgugaccgaggagaucgccgugcagaacuggcuggccagagugggcagagagagacugagcagaauggccaucagcggcgacgacugcguggugaagccccuggacgacagauucgccagcgcccugaccgcccugaacgacaugggcaaggugagaaaggacauccagcagugggagcccagcaagggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugaaggagaccgccugccugggcaagagcuacgcccagauguggagccugauguacuuccacagaagagaccugagacuggccgccaacgccaucugcagcgccgugcccagccacugggugcccaccagcagaaccaccuggagcauccacgccaagcacgaguggaugaccaccgaggacaugcugaccguguggaacagaguguggauccaggagaaccccuggauggaggacaagacccccguggagagcugggaggaggugcccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 17480 - RNA, 9876 nt, Artificial Sequence
  derived and/or modified CDS sequence (opt4) from DENV-2__EU482667__SS-prME
agcgccggcaugaucaucaugcugauccccaccgugauggccuuccaccugaccaccagaaacggcgagccccacaugaucgugggcauccaggagaagggcaagagccugcuguucaagaccgaggacggcgugaacaugugcacccugauggccauggaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgcccagagaaucgagaccuggauccugagacaccccggcuucaccaucauggccgccauccuggccuacaccaucggcaccacccacuuccagagagugcugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaaggaggagcaggacaagagauucgugugcaagcacagcaugguggacagaggcuggggcaacggcugcggccuguucggcaagggcggcaucgugaccugcgccauguucaccugcaagaagaacauggagggcaagaucgugcagcccgagaaccuggaguacaccaucguggugaccccccacagcggcgaggagcacgccgugggcaacgacaccggcaagcacggcaaggagaucaaggugaccccccagagcagcaucaccgaggccgagcugaccggcuacggcaccgugaccauggagugcagccccagaaccggccuggacuucaacgagauggugcugcugcagauggagaacaaggccuggcuggugcacagacagugguuccuggaccugccccugcccuggcugcccggcgccgacaagcaggagagcaacuggauccagaaggaggcccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucgugaucaaggugcaguacgagggcgacggcagccccugcaagauccccuucgagaucauggaccuggagaagagauacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcaucgugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccaggaggagggcaucugcggcaucagaagcgugaccagacuggagaaccugauguggaagcagaucacccccgagcugaaccacauccuggccgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagcuacaaccagaccuuccugaucgacggccccgagaccgccgagugccccaacaccaacagagccuggaacagccuggagguggaggacuacggcuucggcguguucaccaccaacaucuggcugaagcugaaggagaagcaggacguguucugcgacagcaagcugaugagcgccgccaucaaggacaacagagccgugcacgccgacaugggcuacuggaucgagagcgcccugaacgacaccuggaagaucgagaaggccagcuucaucgaggugaagaacugccacuggcccaagagccacacccuguggagcaacggcgugcuggagagcgagaugaucauccccaagaaccuggccggccccgugagccagcacaacuacagacccggcuaccacacccagaucgccggccccuggcaccugggcaagcuggagauggacuucgacuucugcgacggcaccaccgugaucgugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagguggacaacuucagccugggcgugcugggcauggcccuguuccuggaggagaugcugagaaccagagugggcaccaagcacgccauccugcugguggccgugagcuucgugacccugaucaccggcaacaugagcuucaaggaccugggcagagugguggugauggugggcgccaccauggccgacgacaucggcaugggcgugaccuaccuggcccugcuggccgccuucaaggugagacccaccuucgccgccggccugcugcugagaaagcugaccagcaaggagcugaugaugaccaccaucggcaucgugcugcugagccagagcaccauccccgagaccgugcuggagcugaccgacgcccuggcccugggcaugauggugcugaagaucgugagaaacauggagaaguaccagcuggccgugaccaucauggccauccugugcgugcccaacgccgugauccugcagaacgccuggaaggugagcugcaccauccuggccguggugagcgugagcccccugcugcugaccagcagccagcagaagaccgacuggaucccccuggcccugaccaucaagggccugaaccccaccgccaucuuccugaccacccugagcagaaccaacaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccaccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggccuguuccccaucagcauccccaucaccgccgccgccugguaccugugggaggugaagaagcagagagccggcgugcugugggacgugcccagccccccccccaugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacaagggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucaucgacaagaagggcaagguggugggccuguacggcaacggcguggugaccagaagcggcgccuacgugagcgccaucgcccagaccgagaagagcaucgaggacaaccccgagaucgaggacgacaucuucagaaagagaagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucaucgacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaagauggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaagaccagagacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcagaggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggacuucggccugggcagcaucgccacccagcagcccgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggaccccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaucccccccgagaagugcgacacccugcugugcgacaucggcgagagcagccccaaccccaccguggaggccggcagaacccugagagugcugaaccugguggagaacuggcugaacaacaacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccagcggcaacaucgugagcagcgugaacaugaucagcagaaugcugaucaacagauucaccaugagacacaagaaggccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacgugcugcccaccgugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcagauucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacauggagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcguguucaagaacauccagcaccugaccgugaccgaggagguggccgugcagaacuggcuggccagagugggcagagagagacugagcagaauggccaucagcggcgacgacugcguggugaagccccuggacgacagauucgccaacgcccugaccgcccugaacgacaugggcaagaucagaaaggacauccagcagugggagcccagcaagggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugagagagaccgccugccugggcaagagcuacgcccagauguggagccugauguacuuccacagaagagaccugagacuggccgccaacgccaucugcagcgccgugcccagccacugggugcccaccagcagaaccaccuggagcauccacgccaagcacgaguggaugaccaccgaggacaugcugaccguguggaacagaguguggaucagagagaaccccuggauggaggacaagacccccguggagagcugggaggagauccccuaccugggcaagagagaggaccaguggugcggcagccugaucggccugaccagcagagccaccugggccaagaacauccaggccgccaucaaccaggugagaagccugaucggcaacgaggaguacaccgacuacaugcccagcaugaagagauucagaagagaggaggaggaggccggcgugcugugguga

SEQ ID NO: 17481 - RNA, 9876 nt, Artificial Sequence
  derived and/or modified CDS sequence (opt4) from DENV-2__EU482668__SS-prME
agcgccggcaugaucaucaugcugauccccaccgugauggccuuccaccugaccaccagaaacggcgagccccacaugaucgugggcauccaggagaagggcaagagccugcuguucaagaccgaggacggcgugaacaugugcacccugauggccauggaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgcccagagaaucgagaccuggauccugagacaccccggcuucaccaucauggccgccauccuggccuacaccaucggcaccacccacuuccagagagugcugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaaggaggagcaggacaagagauucgugugcaagcacagcaugguggacagaggcuggggcaacggcugcggccuguucggcaagggcggcaucgugaccugcgccauguucaccugcaagaagaacauggagggcaagaucgugcagcccgagaaccuggaguacaccaucguggugaccccccacagcggcgaggagcacgccgugggcaacgacaccggcaagcacggcauggagaucaaggugaccccccagagcagcaucaccgaggccgagcugaccggcuacggcaccgugaccauggagugcagccccagaaccggccuggacuucaacgagauggugcugcugcagauggagaacaaggccuggcuggugcacagacagugguuccuggaccugccccugcccuggcugcccggcgccgacaagcaggagagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucgugaucagagugcaguacgagggcgacggcagccccugcaagauccccuucgagaucauggaccuggagaagagauacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcaucgugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccaggaggagggcaucugcggcaucagaagcgugaccagacuggagaaccugauguggaagcagaucacccccgagcugaaccacauccuggccgagaacgaggugaagcugaccaucaugaccggcgacaucagaggcaucaugcaggccggcaagagaagccugagaccccagcccaccgagcugaaguacagcuggaagaccuggggcaaggccaagaugcugagcaccgagagcuacaaccagaccuuccugaucgacggccccgagaccgccgagugccccaacaccaacagagccuggaacagccuggagguggaggacuacggcuucggcguguucaccaccaacaucuggcugaagcugaaggagaagcaggacgccuucugcgacagcaagcugaugagcgccgccaucaaggacaacagagccgugcacgccgacaugggcuacuggaucgagagcgcccugaacgacaccuggaagaucgagaaggccagcuucaucgaggugaagaacugccacuggcccaagagccacacccuguggagcaacggcgugcuggagagcgagaugaucauccccaagaaccuggccggccccgugagccagcacaacuacagacccggcuaccacacccagaucgccggccccuggcaccugggcaagcuggagauggacuucgacuucugcgacggcaccaccgugaucgugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagguggacaacuucagccugggcgugcugggcauggcccuguuccuggaggagaugcugagaaccagagugggcaccaagcacgccauccugcugguggccgugagcuucgugacccugaucaccggcaacaugagcuucaaggaccugggcagagugguggugauggugggcgccaccauggccgacgacaucggcaugggcgugaccuaccuggcccugcuggccgccuucaaggugagacccaccuucgccgccggccugcugcugagaaagcugaccagcaaggagcugaugaugaccaccaucggcaucgugcugcugagccagagcaccauccccgagaccgugcuggagcugaccgacgcccuggcccugggcaugauggugcugaagaucgugagaaacauggagaaguaccagcuggccgugaccaucauggccauccugugcgugcccaacgccgugauccugcagaacgccuggaaggugagcugcaccauccuggccguggugagcgugagcccccugcugcugaccagcagccagcagaagaccgacuggaucccccuggcccugaccaucaagggccugaaccccaccgccaucuuccugaccacccugagcagaaccaacaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccaccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggccuguuccccaucagcauccccaucaccgccgccgccugguaccugugggaggugaagaagcagagagccggcgugcugugggacgugcccagccccccccccaugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacaagggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucaucgacaagaagggcaagguggugggccuguacggcaacggcguggugaccagaagcggcgccuacgugagcgccaucgcccagaccgagaagagcaucgaggacaaccccgagaucgaggacgacaucuucagaaagagaagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucaucgacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaagauggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaagaccagagacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcagaggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucgccacccagcagcccgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggaccccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaucccccccgagaagugcgacacccugcugugcgacaucggcgagagcagccccaaccccaccguggaggccggcagaacccugagagugcugaaccugguggagaacuggcugaacaacaacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccagcggcaacaucgugagcagcgugaacaugaucagcagaaugcugaucaacagauucaccaugagacacaagaaggccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacgugcugcccaccgugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcagauucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacauggagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcguguucaagaacauccagcaccugaccgugaccgaggagguggccgugcacaacuggcuggccagagugggcagagagagacugagcagaauggccaucagcggcgacgacugcguggugaagccccuggacgacagauucgccaacgcccugaccgcccugaacgacaugggcaagaucagaaaggacauccagcagugggagcccagcaagggcuggaacgacuggacccaggugcccuucugcagccaccacuuccacgagcugaucaugaaggacggcagaauccugguggugcccugcagaaaccaggacgagcugaucggcagagccagaaucagccagggcgccggcuggagccugagagagaccgccugccugggcaagagcuacgcccagauguggagccugauguacuuccacagaagagaccugagacuggccgccaacgccaucugcagcgccgugcccagccacugggugcccaccagcagaaccaccuggagcauccacgccaagcacgaguggaugaccaccgaggacaugcugaccguguggaacagaguguggaucagagagaaccccuggauggaggacaagacccccguggagagcugggaggagauccccuaccugggcaagagagaggaccaguggugcggcagccugaucggccugaccagcagagccaccugggccaagaacauccaggccgccaucaaccaggugagaagccugaucggcaacgaggaguacaccgacuacaugcccagcaugaagagauucagaagagaggaggaggaggccggcgugcugugguga

SEQ ID NO: 17482 - RNA, 9876 nt, Artificial Sequence
  derived and/or modified CDS sequence (opt4) from DENV-2__EU482669__SS-prME
agcgccggcaugaucaucaugcugauccccaccgugauggccuuccaccugaccaccagaaacggcgagccccacaugaucgugggcauccaggagaagggcaagagccugcuguucaagaccgaggacggcgugaacaugugcacccugauggccauggaccugggcgagcugugcgaggacaccaucaccuacaagugcccccugcugagacagaacgagcccgaggacaucgacugcuggugcaacagcaccagcgccugggugaccuacggcaccugcaccaccaccggcgagcacagaagagagaagagaagcguggcccuggugccccacgugggcaugggccuggagaccagaaccgagaccuggaugagcagcgagggcgccuggaagcacgcccagagaaucgagaccuggauccugagacaccccggcuucaccaucauggccgccauccuggccuacaccaucggcaccacccacuuccagagagugcugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaaggaggagcaggacaagagauucgugugcaagcacagcaugguggacagaggcuggggcaacggcugcggccuguucggcaagggcggcaucgugaccugcgccauguucaccugcaagaagaacauggagggcaagaucgugcagcccgagaaccuggaguacaccaucguggugaccccccacagcggcgaggagcacgccgugggcaacgacaccggcaagcacggcaaggagaucaaggugaccccccagagcagcaucaccgagguggagcugaccggcuacggcaccgugaccauggagugcagccccagaaccggccuggacuucaacgagauggugcugcugcagauggagaacaaggccuggcuggugcacagacagugguuccuggaccugccccugcccuggcugcccggcgccgacaagcaggagagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucgugaucagagugcaguacgagggcgacggcagccccugcaagauccccuucgagaucauggaccuggagaagagauacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcaucgugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccaggaggagggcaucugcggcaucagaagcgugaccagacuggagaaccugauguggaagcagaucacccccgagcugaaccacauccuggccgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagcuacaaccagaccuuccugaucgacggccccgagaccgccgagugccccaacaccaacagagccuggaacagccuggagguggaggacuacggcuucggcguguucaccaccaacaucuggcugaagcugaaggagaagcaggacgccuucugcgacagcaagcugaugagcgccgccaucaaggacaacagagccgugcacgccgacaugggcuacuggaucgagagcgcccugaacgacaccuggaagaucgagaaggccagcuucaucgaggugaagaacugccacuggcccaagagccacacccuguggagcaacggcgugcuggagagcgagaugaucauccccaagaaccuggccggccccgugagccagcacaacuacagacccggcuaccacacccagaucgccggccccuggcaccugggcaagcuggagauggacuucgacuucugcgacggcaccaccgugaucgugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagguggacaacuucagccugggcgugcugggcauggcccuguuccuggaggagaugcugagaaccagagugggcaccaagcacgccauccugcugguggccgugagcuucgugacccugaucaccggcaacaugagcuucaaggaccugggcagagugguggugauggugggcgccaccauggccgacgacaucggcaugggcgugaccuaccuggcccugcuggccgccuucaaggugagacccaccuucgccgccggccugcugcugagaaagcugaccagcaaggagcugaugaugaccaccaucggcaucgugcugcugagccagagcaccauccccgagaccgugcuggagcugaccgacgcccuggcccugggcaugauggugcugaagaucgugagaaacauggagaaguaccagcuggccgugaccaucauggccauccugugcgugcccaacgccgugauccugcagaacgccuggaaggugagcugcaccauccuggccguggugagcgugagcccccugcugcugaccagcagccagcagaagaccgacuggaucccccuggcccugaccaucaagggccugaaccccaccgccaucuuccugaccacccugagcagaaccaacaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccaccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggccuguuccccaucagcauccccaucaccgccgccgccugguaccugugggaggugaagaagcagagagccggcgugcugugggacgugcccagccccccccccaugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacaagggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucaucgacaagaagggcaagguggugggccuguacggcaacggcguggugaccagaagcggcgccuacgugagcgccaucgcccagaccgagaagagcaucgaggacaaccccgagaucgaggacgacaucuucagaaagagaagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucaaggccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucaucgacgaggagagagagauccccgagagaagcuggaacagcggccacgagugggugaccgacuacaagggcaagaccgugugguucgugcccagcaucaaggccggcaacgacaucgccgccugccugagaaagaacggcaagaaggugauccagcugagcagaaagaccuucgacagcgaguacgugaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaagauggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaagaccagagacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcagaggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucgccacccagcagcccgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggaccccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaucccccccgagaagugcgacacccugcugugcgacaucggcgagagcagccccaaccccaccguggaggccggcagaacccugagagugcugaaccugguggagaacuggcugaacaacaacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccagcggcaacaucgugagcagcgugaacaugaucagcagaaugcugaucaacagauucaccaugagacacaagaaggccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacgugcugcccaccgugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcagauucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacauggagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcguguucaagaccauccagcaccugaccgugaccgaggagguggccgugcagaacuggcuggccagagugggcagagagagacugagcagaauggccaucagcggcgacgacugcguggugaagccccuggacgacagauucgccaacgcccugaccgcccugaacgacaugggcaagaucagaaaggacauccagcagugggagcccagcaagggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugagagagaccgccugccugggcaagagcuacgcccagauguggagccugauguacuuccacagaagagaccugagacuggccgccaacgccaucugcagcgccgugcccagccacugggugcccaccagcagaaccaccuggagcauccacgccaagcacgaguggaugaccaccgaggacaugcugaccguguggaacagaguguggaucagagagaaccccuggauggaggacaagacccccguggagagcugggaggagauccccuaccugggcaagagagaggaccaguggugcggcagccugaucggccugaccagcagagccaccugggccaagaacauccaggccgccaucaaccaggugagaagccugaucggcaacgaggaguacaccgacuacaugcccagcaugaagagauucagaagagaggaggaggaggccggcgugcugugguga

SEQ ID NO: 17483 - RNA, 9876 nt, Artificial Sequence
  derived and/or modified CDS sequence (opt4) from DENV-2__EU482670__SS-prME
agcgccggcaugaucaucaugcugauccccaccgugauggccuuccaccugaccaccagaaacggcgagccccacaugaucgugggcauccaggagaagggcaagagccugcuguucaagaccgaggacggcgugaacaugugcacccugauggccauggaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgcccagagaaucgagaccuggauccugagacaccccggcuucaccaucauggccgccauccuggccuacaccaucggcaccacccacuuccagagagugcugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaaggaggagcaggacaagagauucgugugcaagcacagcaugguggacagaggcuggggcaacggcugcggccuguucggcaagggcggcaucgugaccugcgccauguucaccugcaagaagaacauggagggcaagaucgugcagcccgagaaccuggaguacaccaucguggugaccccccacagcggcgaggagcacgccgugggcaacgacaccggcaagcacggcaaggagaucaaggugaccccccagagcagcaucaccgaggccgagcugaccggcuacggcaccgugaccauggagugcagccccagaaccggccuggacuucaacgagauggugcugcugcagauggagaacaaggccuggcuggugcacagacagugguuccuggaccugccccugcccuggcugcccggcgccgacaagcaggagagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaaggugaugaaggagaucgccgagacccagcacggcaccaucgugaucagagugcaguacgagggcgacggcagccccugcaagauccccuucgagaucauggaccuggagaagagauacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcaucgugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccaggaggagggcaucugcggcaucagaagcgugaccagacuggagaaccugauguggaagcagaucacccccgagcugaaccacauccuggccgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucaccaccaacaucuggcugaagcugaaggagaagcaggacgccuucugcgacagcaagcugaugagcgccgccaucaaggacaacagagccgugcacgccgacaugggcuacuggaucgagagcgcccugaacgacaccuggaagaucgagaaggccagcuucaucgaggugaagaacugccacuggcccaagagccacacccuguggagcaacggcgugcuggagagcgagaugaucauccccaagaaccuggccggccccgugagccagcacaacuacagacccggcuaccacacccagguggccggccccuggcaccugggcaagcuggagauggacuucgacuucugcgacggcaccaccgugaucgugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagguggacaacuucagccugggcgugcugggcauggcccuguuccuggaggagaugcugagaaccagagugggcaccaagcacgccauccugcugguggccgugagcuucgugacccugaucaccggcaacaugagcuucaaggaccugggcagagugguggugauggugggcgccaccauggccgacgacaucggcaugggcgugaccuaccuggcccugcuggccgccuucaaggugagacccaccuucgccgccggccugcugcugagaaagcugaccagcaaggagcugaugaugaccaccaucggcaucgugcugcugagccagagcaccauccccgagaccgugcuggagcugaccgacgcccuggcccugggcaugauggugcugaagaucgugagaaacauggagaaguaccagcuggccgugaccaucauggccauccugugcgugcccaacgccgugauccugcagaacgccuggaaggugagcugcaccauccuggccguggugagcgugagcccccugcugcugaccagcagccagcagaagaccgacuggaucccccuggcccugaccaucaagggccugaaccccaccgccaucuuccugaccacccugagcagaaccaacaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccaccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggccuguuccccaucagcauccccaucaccgccgccgccugguaccugugggaggugaagaagcagagagccggcgugcugugggacgugcccagccccccccccaugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacaagggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucaucgacaagaagggcaagguggugggccuguacggcaacggcguggugaccagaagcggcgccuacgugagcgccaucgcccagaccgagaagagcaucgaggacaaccccgagaucgaggacgacaucuucagaaagagaagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucaucgacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaagauggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaagaccagagacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcagaggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucgccacccagcagcccgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggaccccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaugggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaucccccccgagaagugcgacacccugcugugcgacaucggcgagagcagccccaaccccaccguggaggccggcagaacccugagagugcugaaccugguggagaacuggcugaacaacaacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccagcggcaacaucgugagcagcgugaacaugaucagcagaaugcugaucaacagauucaccaugagacacaagaaggccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacgugcugcccaccgugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcagauucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacauggagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcguguucaagaacauccagcaccugaccgugaccgaggagguggccgugcagaacuggcuggccagagugggcagagagagacugagcagaauggccaucagcggcgacgacugcguggugaagccccuggacgacagauucgccaacgcccugaccgcccugaacgacaugggcaagaucagaaaggacauccagcagugggagcccagcaagggcuggaacgacuggacccaggugcccuucugcagccaccacuuccacgagcugaucaugaaggacggcagaauccugguggugcccugcagaaaccaggacgagcugaucggcagagccagaaucagccagggcgccggcuggagccugagagagaccgccugccugggcaagagcuacgcccagauguggagccugauguacuuccacagaagagaccugagacuggccgccaacgccaucugcagcgccgugcccagccacugggugcccaccagcagaaccaccuggagcauccacgccaagcacgaguggaugaccaccgaggacaugcugaccguguggaacagaguguggaucagagagaaccccuggauggaggacaagacccccguggagagcugggaggagauccccuaccugggcaagagagaggaccaguggugcggcagccugaucggccugaccagcagagccaccugggccaagaacauccaggccgccaucaaccaggugagaagccugaucggcaacgaggaguacaccgacuacaugcccagcaugaagagauucagaagagaggaggaggaggccggcgugcugugguga

SEQ ID NO: 17484 - RNA, 9876 nt, Artificial Sequence
  derived and/or modified CDS sequence (opt4) from DENV-2__EU482671__SS-prME
agcgccggcaugaucaucaugcugauccccaccgugauggccuuccaccugaccaccagaaacggcgagccccacaugaucgugggcauccaggagaagggcaagagccugcuguucaagaccgaggacggcgugaacaugugcacccugauggccauggaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgcccagagaaucgagaccuggauccugagacaccccggcuucaccaucauggccgccauccuggccuacaccaucggcaccacccacuuccagagagugcugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaaggaggagcaggacaagagauucaucugcaagcacagcaugguggacagaggcuggggcaacggcugcggccuguucggcaagggcggcaucgugaccugcgccauguucaccugcaagaagaacauggagggcaagaucgugcagcccgagaaccuggaguacaccaucguggugaccccccacagcggcgaggagcacgccgugggcaacgacaccggcaagcacggcaaggagaucaaggugaccccccagagcagcaucaccgaggccgagcugaccggcuacggcaccgugaccauggagugcagccccagaaccggccuggacuucaacgagauggugcugcugcagauggagaacaaggccuggcuggugcacagacagugguuccuggaccugccccugcccuggcugcccggcgccgacaagcaggagagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagguggugagagagaucgccgagacccagcacggcaccaucgugaucagagugcaguacgagggcgacggcagccccugcaagauccccuucgagaucauggaccuggagaagagauacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcaucgugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccaggaggagggcaucugcggcaucagaagcgugaccagacuggagaaccugauguggaagcagaucacccccgagcugaaccacauccuggccgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagcuacaaccagaccuuccugaucgacggccccgagaccgccgagugccccaacaccaacagagccuggaacagccuggagguggaggacuacggcuucggcguguucaccaccaacaucuggcugaagcugaaggagaagcaggacgccuucugcgacagcaagcugaugagcgccgccaucaaggacaacagagccgugcacgccgacaugggcuacuggaucgagagcgcccugaacgacaccuggaagaucgagaaggccagcuucaucgaggugaagaacugccacuggcccaagagccacacccuguggagcaacggcgugcuggagagcgagaugaucauccccaagaaccuggccggccccgugagccagcacaacuacagacccggcuaccacacccagaucgccggccccuggcaccugggcaagcuggagauggacuucgacuucugcgacggcaccaccgugaucgugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagguggacaacuucagccugggcgugcugggcauggcccuguuccuggaggagaugcugagaaccagagugggcaccaagcacgccauccugcugguggccgugagcuucgugacccugaucaccggcaacaugagcuucaaggaccugggcagagugguggugauggugggcgccaccauggccgacgacaucggcaugggcgugaccuaccuggcccugcuggccgccuucaaggugagacccaccuucgccgccggccugcugcugagaaagcugaccagcaaggagcugaugaugaccaccaucggcaucgugcugcugagccagagcaccauccccgagaccgugcuggagcugaccgacgcccuggcccugggcaugauggugcugaagaucgugagaaacauggagaaguaccagcuggccgugaccaucauggccauccugugcgugcccaacgccgugauccugcagaacgccuggaaggugagcugcaccauccuggccguggugagcgugagcccccugcugcugaccagcagccagcagaagaccgacuggaucccccuggcccugaccaucaagggccugaaccccaccgccaucuuccugaccacccugagcagaaccaacaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccaccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggccuguuccccaucagcauccccaucaccgccgccgccugguaccugugggaggugaagaagcagagagccggcgugcugugggacgugcccagccccccccccaugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacaagggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucaucgacaagaagggcaagguggugggccuguacggcaacggcguggugaccagaagcggcgccuacgugagcgccaucgcccagaccgagaagagcaucgaggacaaccccgagaucgaggacgacaucuucagaaagagaagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucaucgacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaagauggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaagaccagagacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcagaggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucgccacccagcagcccgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggaccccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaugggcgagacccugggcgagaaguggaagagcagacugaacgcccugggcaagagcgaguuccagaucuacaagagaagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaucccccccgagaagugcgacacccugcugugcgacaucggcgagagcagccccaaccccaccguggaggccggcagaacccugagagugcugaaccugguggagaacuggcugaacaacaacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccagcggcaacaucgugagcagcgugaacaugaucagcagaaugcugaucaacagauucaccaugagacacaagaaggccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacgugcugcccaccgugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcagauucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacauggagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcguguucaagaacauccagcaccugaccgugaccgaggagguggccgugcagaacuggcuggccagagugggcagagagagacugagcagaauggccaucagcggcgacgacugcguggugaagccccuggacgacagauucgccaacgcccugaccgcccugaacgacaugggcaagaucagaaaggacauccagcagugggagcccagcaagggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugagagagaccgccugccugggcaagagcuacgcccagauguggagccugauguacuuccacagaagagaccugagacuggccgccaacgccaucugcagcgccgugcccagccacugggugcccaccagcagaaccaccuggagcauccacgccaagcacgaguggaugaccaccgaggacaugcugaccguguggaacagaguguggaucagagagaaccccuggauggaggacaagacccccguggagagcugggaggagauccccuaccugggcaagagagaggaccaguggugcggcagccugaucggccugaccagcagagccaccugggccaagaacauccaggccgccaucaaccaggugagaagccugaucggcaacgaggaguacaccgacuacaugcccagcaugaagagauucagaagagaggaggaggaggccggcgugcugugguga

SEQ ID NO: 17485 - RNA, 9876 nt, Artificial Sequence
  derived and/or modified CDS sequence (opt4) from DENV-2__EU482674__SS-prME
agcgccggcaugaucaucaugcugauccccaccgugauggccuuccaccugaccaccagaaacggcgagccccacaugaucgugagcauccaggagaagggcaagagccugcuguucaagaccgaggacggcgugaacaugugcacccugauggccauggaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgcccagagaaucgagaccuggauccugagacaccccggcuucaccaucauggccgccauccuggccuacaccaucggcaccacccacuuccagagagugcugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaaggaggagcaggacaagagauucgugugcaagcacagcaugguggacagaggcuggggcaacggcugcggccuguucggcaagggcggcaucgugaccugcgccauguucaccugcaagaagaacauggagggcaagaucgugcagcccgagaaccuggaguacaccaucguggugaccccccacagcggcgaggagcacgccgugggcaacgacaccggcaagcacggcaaggagaucaaggugaccccccagagcagcaucaccgaggccgagcugaccggcuacggcaccgugaccauggagugcagccccagaaccggccuggacuucaacgagauggugcugcugcagauggagaacaaggccuggcuggugcacagacagugguuccuggaccugccccugcccuggcugcccggcgccgacaagcaggagagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucgugaucagagugcaguacgagggcgacggcagccccugcaagauccccuucgagaucauggaccuggagaagagauacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcaucgugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccaggaggagggcaucugcggcaucagaagcgugaccagacuggagaaccugauguggaagcagaucacccccgagcugaaccacauccuggccgagaacgaggugaagcugaccaucaugaccggcgacaucagaggcaucaugcaggccggcaagagaagccugagaccccagcccaccgagcugaaguacagcuggaagaccuggggcaaggccaagaugcugagcaccgagagcuacaaccagaccuuccugaucgacggccccgagaccgccgagugccccaacaccaacagagccuggaacagccuggagguggaggacuacggcuucggcguguucaccaccaacaucuggcugaagcugaaggagaagcaggacgccuucugcgacagcaagcugaugagcgccgccaucaaggacaacagagccgugcacgccgacaugggcuacuggaucgagagcgcccugaacgacaccuggaagaucgagaaggccagcuucaucgaggugaagaacugccacuggcccaagagccacacccuguggagcaacggcgugcuggagagcgagaugaucauccccaagaaccuggccggccccgugagccagcacaacuacagacccggcuaccacacccagaucgccggccccuggcaccugggcaagcuggagauggacuucgacuucugcgacggcaccaccgugaucgugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagguggacaacuucagccugggcgugcugggcauggcccuguuccuggaggagaugcugagaaccagagugggcaccaagcacgccauccugcugguggccgugagcuucgugacccugaucaccggcaacaugagcuucaaggaccugggcagagugguggugauggugggcgccaccauggccgacgacaucggcaugggcgugaccuaccuggcccugcuggccgccuucaaggugagacccaccuucgccgccggccugcugcugagaaagcugaccagcaaggagcugaugaugaccaccaucggcaucgugcugcugagccagagcaccauccccgagaccgugcuggagcugaccgacgcccuggcccugggcaugauggugcugaagaucgugagaaacauggagaaguaccagcuggccgugaccaucauggccauccugugcgugcccaacgccgugauccugcagaacgccuggaaggugagcugcaccauccuggccguggugagcgugagcccccugcugcugaccagcagccagcagaagaccgacuggaucccccuggcccugaccaucaagggccugaaccccaccgccaucuuccugaccacccugagcagaaccaacaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccaccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggccuguuccccaucagcauccccaucaccgccgccgccugguaccugugggaggugaagaagcagagagccggcgugcugugggacgugcccagccccccccccaugggcaaggccgagcuggaggacggcgccuacagaaucaagcagaagggcauccugggccacagccagaucggcgccggcguguacaaggagggcaccuuccacaccauguggcacgugaccagaggcgccgugcugaugcacaagggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucaucgacaagaagggcaagguggugggccuguacggcaacggcguggugaccagaagcggcgccuacgugagcgccaucgcccagaccgagaagaacaucgaggacaaccccgagaucgaggacgacaucuucagaaagagaagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucaucgacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaagauggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaagaccagagacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcagaggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucgccacccagcagcccgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggaccccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaucccccccgagaagugcgacacccugcugugcgacaucggcgagagcagccccaaccccaccguggaggccggcagaacccugagagugcugaaccugguggagaacuggcugaacaacaacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccagcggcaacaucgugagcagcgugaacaugaucagcagaaugcugaucaacagauucaccaugagacacaagaaggccaccuacgagcccgacguggaccugggcagcggcaccagaaacaucggcaucgagagcgagaagcccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacgugcugcccaccgugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcagauucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacauggagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcguguucaagaacauccagcaccugaccgugaccgaggagguggccgugcacaacuggcuggccagagugggcagagagagacugagcagaauggccaucagcggcgacgacugcguggugaagccccuggacgacagauucgccaacgcccugaccgcccugaacgacaugggcaagaucagaaaggacauccagcagugggagcccagcaagggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugagagagaccgccugccugggcaagagcuacgcccagauguggagccugauguacuuccacagaagagaccugagacuggccgccaacgccaucugcagcgccgugcccagccacugggugcccaccagcagaaccaccuggagcauccacgccaagcacgaguggaugaccaccgaggacaugcugaccguguggaacagaguguggaucagagagaaccccuggauggaggacaagacccccguggagagcugggaggagauccccuaccugggcaagagagaggaccaguggugcggcagccugaucggccugaccagcagagccaccugggccaagaacauccaggccgccaucaaccaggugagaagccugaucggcaacgaggaguacaccgacuacaugcccagcaugaagagauucagaagagaggaggaggaggccggcgugcugugguga

SEQ ID NO: 17486 - RNA, 9876 nt, Artificial Sequence
  derived and/or modified CDS sequence (opt4) from DENV-2__EU482676__SS-prME
agcgccagcaugaucaucaugcugauccccaccgugauggccuuccaccugaccaccagaaacggcgagccccacaugaucgugggcauccaggagaagggcaagagccugcuguucaagaccgaggacggcgugaacaugugcacccugauggccauggaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgcccagagaaucgagaccuggauccugagacaccccggcuucaccaucauggccgccauccuggccuacaccaucggcaccacccacuuccagagagugcugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucaaggccaagcugaccaacaccaccaccgagagcagaugccccacccagggcgagcccagccugaaggaggagcaggacaagagauucgugugcaagcacagcaugguggacagaggcuggggcaacggcugcggccuguucggcaagggcggcaucgugaccugcgccauguucaccugcaagaagaacauggagggcagaaucgugcagcccgagaaccuggaguacaccaucguggugaccccccacagcggcgaggagcacgccgugggcaacgacaccggcaagcacggcaaggagaucaaggugaccccccagagcagcaucaccgaggccgagcugaccggcuacggcaccgugaccauggagugcagccccagaaccggccuggacuucaacgagauggugcugcugcagauggagaacaaggccuggcuggugcacagacagugguuccuggaccugccccugcccuggcugcccggcgccgacaagcaggagagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucgugaucagagugcaguacgagggcgacggcagccccugcaagauccccuucgagaucauggaccuggagaagagauacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcaucgugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccaggaggagggcaucugcggcaucagaagcgugaccagacuggagaaccugauguggaagcagaucacccccgagcugaaccacauccuggccgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagcuacaaccagaccuuccugaucgacggccccgagaccgccgagugccccaacaccaacagagccuggaacagccuggagguggaggacuacggcuucggcguguucaccaccaacaucuggcugaagcugaaggagaagcaggacguguucugcgacagcaagcugaugagcgccgccaucaaggacaacagagccgugcacgccgacaugggcuacuggaucgagagcgcccugaacgacaccuggaagaucgagagagccagcuucaucgaggugaagaacugccacuggcccaagagccacacccuguggagcaacggcgugcuggagagcgagaugaucauccccaagaaccuggccggccccgugagccagcacaacuacagacccggcuaccacacccagaucgccggccccuggcaccugggcaagcuggagauggacuucgacuucugcgacggcaccaccgugaucgugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagguggacaacuucagccugggcgugcugggcauggcccuguuccuggaggagaugcugagaaccagagugggcaccaagcacgccauccugcugguggccgugagcuucgugacccugaucaccggcaacaugagcuucaaggaccugggcagagugguggugauggugggcgccaccauggccgacgacaucggcaugggcgugaccuaccuggcccugcuggccgccuucaaggugagacccaccuucgccgccggccugcugcugagaaagcugaccagcaaggagcugaugaugaccaccaucggcaucgugcugcugagccagagcaccauccccgagaccgugcuggagcugaccgacgcccuggcccugggcaugauggugcugaagaucgugagaaacauggagaaguaccagcuggccgugaccaucauggccauccugugcgugcccaacgccgugauccugcagaacgccuggaaggugagcugcaccauccuggccguggugagcgugagcccccugcugcugaccagcagccagcagaagaccgacuggaucccccuggcccugaccaucaagggccugaaccccaccgccaucuuccugaccacccugagcagaaccaacaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccaccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggccuguuccccaucagcauccccaucaccgccgccgccugguaccugugggaggugaagaagcagagagccggcgugcugugggacgugcccagccccccccccaugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacaagggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucaucgacaagaagggcaagguggugggccuguacggcaacggcguggugaccagaagcggcgccuacgugagcgccaucgcccagaccgagaagagcaucgaggacaaccccgagaucgaggacgacaucuucagaaagagaagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucaucgacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaagauggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaagaccagagacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcagaggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggacuucggccugggcagcaucgccacccagcagcccgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggaccccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugagaaacgugagagaggugaagggccugaccaagggcggccccggccacgaggagcccauccccaugagcaccuacggcuggaaccuggugagacugcagagcggcguggacguguucuucaucccccccgagaagugcgacacccugcugugcgacaucggcgagagcagccccaaccccaccguggaggccggcagaacccugagagugcugaaccugguggagaacuggcugaacaacaacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccagcggcaacaucgugagcagcgugaacaugaucagcagaaugcugaucaacagauucaccaugagacacaagaaggccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacgugcugcccaccgugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcagauucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacauggagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcguguucaagaacauccagcaccugaccgugaccgaggagguggccgugcagaacuggcuggccagagugggcagagagagacugagcagaauggccaucagcggcgacgacugcguggugaagccccuggacgacagauucgccaacgcccugaccgcccugaacgacaugggcaagaucagaaaggacauccagcagugggagcccagcaagggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugagagagaccgccugccugggcaagagcuacgcccagauguggagccugauguacuuccacagaagagaccugagacuggccgccaacgccaucugcagcgccgugcccagccacugggugcccaccagcagaaccaccuggagcauccacgccaagcacgaguggaugaccaccgaggacaugcuggccguguggaacagaguguggaucagagagaaccccuggauggaggacaagacccccguggagagcugggaggagauccccuaccugggcaagagagaggaccaguggugcggcagccugaucggccugaccagcagagccaccugggccaagaacauccaggccgccaucaaccaggugagaagccugaucggcaacgaggaguacaccgacuacaugcccagcaugaagagauucagaagagaggaggaggaggccggcgugcugugguga

SEQ ID NO: 17487 - RNA, 9876 nt, Artificial Sequence
  derived and/or modified CDS sequence (opt4) from DENV-2__EU482677__SS-prME
agcgccggcaugaucaucaugcugauccccaccgugauggccuuccaccugaccaccagaaacggcgagccccacaugaucgugggcauccaggagaagggcaagagccugcuguucaagaccgaggacggcgugaacaugugcacccugauggccauggaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgcccagagaaucgagaccuggauccugagacaccccggcuucaccaucauggccgccauccuggccuacaccaucggcaccacccacuuccagagagugcugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaaggaggagcaggacaagagauucgugugcaagcacagcaugguggacagaggcuggggcaacggcugcggccuguucggcaagggcggcaucgugaccugcgccauguucaccugcaagaagaacauggagggcaagaucgugcagcccgagaaccuggaguacaccaucguggugaccccccacagcggcgaggagcacgccgugggcaacgacaccggcaagcacggcaaggagaucaaggugaccccccagagcagcaucaccgaggccgagcugaccggcuacggcaccgugaccauggagugcagccccagaaccggccuggacuucaacgagauggugcugcugcagauggagaacaaggccuggcuggugcacagacagugguuccuggaccugccccugcccuggcugcccggcgccgacaagcaggagagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucgugaucagagugcaguacgagggcgacggcagccccugcaagauccccuucgagaucauggaccuggagaagagauacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcaucgugacccuguaccugggcgugauggugcaggccgacagcggcugcguggugagcuggaagaacaaggagcugaagugcggcagcggcaucuucgugaccgacaacgugcacaccuggaccgagcaguacaaguuccagcccgagagccccagcaagcuggccagcgccauccagaaggcccaggaggagggcaucugcggcaucagaagcgugaccagacuggagaaccugauguggaagcagaucacccccgagcugaaccacauccuggccgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagcuacaaccagaccuuccugaucgacggccccgagaccgccgagugccccaacaccaacagagccuggaacagccuggagguggaggacuacggcuucggcguguucaccaccaacaucuggcugaagcugaaggagaagcaggacgccuucugcgacagcaagcugaugagcgccgccaucaaggacaacagagccgugcacgccgacaugggcuacuggaucgagagcgcccugaacgacaccuggaagaucgagaaggccagcuucaucgaggugaagaacugccacuggcccaagagccacacccuguggagcaacggcgugcuggagagcgagaugaucauccccaagaaccuggccggccccgugagccagcacaacuacagacccggcuaccacacccagaucgccggccccuggcaccugggcaagcuggagauggacuucgacuucugcgacggcaccaccgugaucgugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagguggacaacuucagccugggcgugcugggcauggcccuguuccuggaggagaugcugagaaccagagugggcaccaagcacgccauccugcugguggccgugagcuucgugacccugaucaccggcaacaugagcuucaaggaccugggcagagugguggugauggugggcgccaccauggccgacgacaucggcaugggcgugaccuaccuggcccugcuggccgccuucaaggugagacccaccuucgccgccggccugcugcugagaaagcugaccagcaaggagcugaugaugaccaccaucggcaucgugcugcugagccagagcaccauccccgagaccgugcuggagcugaccgacgcccuggcccugggcaugauggugcugaagaucgugagaaacauggagaaguaccagcuggccgugaccaucauggccauccugugcgugcccaacgccgugauccugcagaacgccuggaaggugagcugcaccauccuggccguggugagcgugagcccccugcugcugaccagcagccagcagaagaccgacuggaucccccuggcccugaccaucaagggccugaaccccaccgccaucuuccugaccacccugagcagaaccaacaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccaccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggccuguuccccaucagcauccccaucaccgccgccgccugguaccugugggaggugaagaagcagagagccggcgugcugugggacgugcccagccccccccccaugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacaagggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccagcaccggcaccaucggcgccgugagccuggacuucagccccggcaccagcggcagccccaucaucgacaagaagggcaagguggugggccuguacggcaacggcguggugaccagaagcggcgccuacgugagcgccaucgcccagaccgagaagagcaucgaggacaaccccgagaucgaggacgacaucuucagaaagagaagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucaucgacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccaagaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaagauggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagagacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcagaggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucgccacccagcagcccgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggaccccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaccuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaucccccccgagaagugcgacacccugcugugcgacaucggcgagagcagccccaaccccaccguggaggccggcagaacccugagagugcugaaccugguggagaacuggcugaacaacaacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccagcggcaacaucgugagcagcgugaacaugaucagcagaaugcugaucaacagauucaccaugagacacaagaaggccaccuacgagcccgacguggaccugggcagcggcaccagaaacaucggcaacgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacgugcugcccaccgugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcagauucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacauggagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcguguucaagaacauccagcaccugaccgugaccgaggagguggccgugcagaacuggcuggccagagugggcagagagagacugagcagaauggccaucagcggcgacgacugcguggugaagccccuggacgacagauucgccaacgcccugaccgcccugaacgacaugggcaagaucagaaaggacauccagcagugggagcccagcaagggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugagagagaccgccugccugggcaagagcuacgcccagauguggagccugauguacuuccacagaagagaccugagacuggccgccaacgccaucugcagcgccgugcccagccacugggugcccaccagcagaaccaccuggagcauccacgccaagcacgaguggaugaccaccgaggacaugcugaccguguggaacagaguguggaucagagagaaccccuggauggaggacaagacccccguggagagcugggaggagauccccuaccugggcaagagagaggaccaguggugcggcagccugaucggccugaccagcagagccaccugggccaagaacauccagguggccaucaaccaggugagaagccugaucggcaacgaggaguacaccgacuacaugcccagcaugaagagauucagaagagaggaggaggaggccggcgugcugugguga

SEQ ID NO: 17488 - RNA, 9876 nt, Artificial Sequence
  derived and/or modified CDS sequence (opt4) from DENV-2__EU482678__SS-prME
agcgccggcaugaucaucaugcugauccccaccgugauggccuuccaccugaccaccagaaacggcgagccccacaugaucgugggcauccaggagaagggcaagagccugcuguucaagaccgaggacggcgugaacaugugcacccugauggccauggaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgcccagagaaucgagaccuggauccugagacaccccggcuucaccaucauggccgccauccuggccuacaccaucggcaccacccacuuccagagagugcugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaaggaggagcaggacaagagauucgugugcaagcacagcaugguggacagaggcuggggcaacggcugcggccuguucggcaagggcggcaucgugaccugcgccauguucaccugcaagaagaacauggagggcaagaucgugcagcccgagaaccuggaguacaccaucguggugaccccccacagcggcgaggagcacgccgugggcaacgacaccggcaagcacggcaaggagaucaaggugaccccccagagcagcaucaccgaggccgagcugaccggcuacggcaccgugaccauggagugcagccccagaaccggccuggacuucaacgagauggugcugcugcagauggagaacaaggccuggcuggugcacagacagugguuccuggaccugccccugcccuggcugcccggcgccgacgagcaggagagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucgugaucagagugcaguacgagggcgacggcagccccugcaagauccccuucgagaucauggaccuggagaagagauacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcaucgugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccaggaggagggcaucugcggcaucagaagcgugaccagacuggagaaccugauguggaagcagaucacccccgagcugaaccacauccuggccgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagcuacaaccagaccuuccugaucgacggccccgagaccaccgagugccccaacaccaacagagccuggaacagccuggagguggaggacuacggcuucggcguguucaccaccaacaucuggcugaagcugaaggagaagcaggacgccuucugcgacagcaagcugaugagcgccgccaucaaggacaacagagccgugcacgccgacaugggcuacuggaucgagagcgcccugaacgacaccuggaagaucgagaaggccagcuucaucgaggugaagaacugccacuggcccaagagccacacccuguggagcaacggcgugcuggagagcgagaugaucauccccaagaaccuggccggccccgugagccagcacaacuacagacccggcuaccacacccagaucgccggccccuggcaccugggcaagcuggagauggacuucgacuucugcgacggcaccaccgugaucgugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagguggacaacuucagccugggcgugcugggcauggcccuguuccuggaggagaugcugagaaccagagugggcaccaagcacgccauccugcugguggccgugagcuucgugacccugaucaccggcaacaugagcuucaaggaccugggcagagugguggugauggugggcgccaccauggccgacgacaucggcaugggcgugaccuaccuggcccugcuggccgccuucaaggugagacccaccuucgccgccggccugcugcugagaaagcugaccagcaaggagcugaugaugaccaccaucggcaucgugcugcugagccagagcaccauccccgagaccgugcuggagcugaccgacgcccuggcccugggcaugauggugcugaagaucgugagaaacauggagaaguaccagcuggccgugaccaucauggccauccugugcgugcccaacgccgugauccugcagaacgccuggaaggugagcugcaccauccuggccguggugagcgugagcccccugcugcugaccagcagccagcagaagaccgacuggaucccccuggcccuggccaucaagggccugaaccccaccgccaucuuccugaccacccugagcagaaccaacaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccaccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggccuguuccccaucagcauccccaucaccgccgccgccugguaccugugggaggugaagaagcagagagccggcgugcugugggacgugcccagccccccccccaugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacaagggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucaucgacaagaagggcaagguggugggccuguacggcaacggcguggugaccagaagcggcgccuacgugagcgccaucgcccagaccgagaagagcaucgaggacaaccccgagaucgaggacgacaucuucagaaagagaagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucaucgacgaggagagagagauccccgagagaagcuggaacaccggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaagauggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaagaccagagacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcagaggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucgccacccagcagcccgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggaccccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaucccccccgagaagugcgacacccugcugugcgacaucggcgagagcagccccaaccccaccguggaggccggcagaacccugagagugcugaaccugguggagaacuggcugaacaacaacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccagcggcaacaucgugagcagcgugaacaugaucagcagaaugcugaucaacagauucaccaugagacacaagaaggccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacgugcugcccaccgugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcagauucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacaugaagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcguguucaagaacauccagcaccugaccgugaccgaggagguggccgugcagaacuggcuggccagagugggcagagagagacugagcagaauggccaucagcggcgacgacugcguggugaagccccuggacgacagauucgccaacgcccugaccgcccugaacgacaugggcaagaucagaaaggacauccagcagugggagcccagcaagggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugagagagaccgccugccugggcaagagcuacgcccagauguggagccugauguacuuccacagaagagaccugagacuggccgccaacgccaucugcagcgccgugcccagccacugggugcccaccagcagaaccaccuggagcauccacgccaagcacgaguggaugaccaccgaggacaugcugaccguguggaacagaguguggaucagagagaaccccuggauggaggacaagacccccguggagagcugggaggagauccccuaccugggcaagagagaggaccaguggugcggcagccugaucggccugaccagcagagccaccugggccaagaacauccaggccgccaucaaccaggugagaagccugaucggcaacgaggaguacaccgacuacaugcccagcaugaagagauucagaagagaggaggaggaggccggcgugcugugguga

SEQ ID NO: 17489 - RNA, 9876 nt, Artificial Sequence
  derived and/or modified CDS sequence (opt4) from DENV-2__EU482679__SS-prME
agcgccggcaugaucaucaugcugauccccaccgugauggccuuccaccugaccaccagaaacggcgagccccacaugaucgugggcauccaggagaagggcaagagccugcuguucaagaccgaggacggcgugaacaugugcacccugauggccauggaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgcccagagaaucgagaccuggauccugagacaccccggcuucaccaucauggccgccauccuggccuacaccaucggcaccacccacuuccagagagugcugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaaggaggagcaggacaagagauucgugugcaagcacagcaugguggacagaggcuggggcaacggcugcggccuguucggcaagggcggcaucgugaccugcgccauguucaccugcaagaagaacauggagggcaagaucgugcagcccgagaaccuggaguacaccaucguggugaccccccacagcggcgaggagcacgccgugggcaacgacaccggcaagcacggcaaggagaucaaggugaccccccagagcagcaucaccgaggccgagcugaccggcuacggcaccgugaccauggagugcagccccagaaccggccuggacuucaacgagauggugcugcugcagauggagaacaaggccuggcuggugcacagacagugguuccuggaccugccccugcccuggcugcccggcgccgacaagcaggagagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucgugaucagagugcaguacgagggcgacggcagccccugcaagauccccuucgagaucauggaccuggagaagagauacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcaucgugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccaggaggagggcaucugcggcaucagaagcgugaccagacuggagaaccugauguggaagcagaucacccccgagcugaaccacauccuggccgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucaccaccaacaucuggcugaagcugaaggagaagcaggacgccuucugcgacagcaagcugaugagcgccgccaucaaggacaacagagccgugcacgccgacaugggcuacuggaucgagagcgcccugaacgacaccuggaagaucgagaaggccagcuucaucgaggugaagaacugccacuggcccaagagccacacccuguggagcaacggcgugcuggagagcgagaugaucauccccaagaaccuggccggccccgugagccagcacaacuacagacccggcuaccacacccagaucgccggccccuggcaccugggcaagcuggagauggacuucgacuucugcgacggcaccaccgugaucgugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagguggacaacuucagccugggcgugcugggcauggcccuguuccuggaggagaugcugagaaccagagugggcaccaagcacgccauccugcugguggccgugagcuucgugacccugaucaccggcaacaugagcuucaaggaccugggcagagugguggugauggugggcgccaccauggccgacgacaucggcaugggcgugaccuaccuggcccugcuggccgccuucaaggugagacccaccuucgccgccggccugcugcugagaaagcugaccagcaaggagcugaugaugaccaccaucggcaucgugcugcugagccagagcaccauccccgagaccgugcuggagcugaccgacgcccuggcccugggcaugauggugcugaagaucgugagaaacauggagaaguaccagcuggccgugaccaucauggccauccugugcgugcccaacgccgugauccugcagaacgccuggaaggugagcugcaccauccuggccguggugagcgugagcccccugcugcugaccagcagccagcagaagaccgacuggaucccccuggcccugaccaucaagggccugaaccccaccgccaucuuccugaccacccugagcagaaccaacaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccaccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggccuguuccccaucagcauccccaucaccgccgccgccugguaccugugggaggugaagaagcagagagccggcgugcugugggacgugcccagccccccccccaugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacaagggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucaucgacaagaagggcaagguggugggccuguacggcaacggcguggugaccagaagcggcgccuacgugagcgccaucgcccagaccgagaagagcaucgaggacaaccccgagaucgaggacgacaucuucagaaagagaagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccaucagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucaucgacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaagauggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaagaccagagacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcagaggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucgccacccagcagcccgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggaccccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaugggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaucccccccgagaagugcgacacccugcugugcgacaucggcgagagcagccccaaccccaccguggaggccggcagaacccugagagugcugaaccugguggagaacuggcugaacaacaacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccagcggcaacaucgugagcagcgugaacaugaucagcagaaugcugaucaacagauucaccaugagacacaagaaggccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacgugcugcccaccgugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugggcaccagagaggaguucaccagaaaggugagaagcaacgccgcccugggcgccaucuucaccgacgagaacaaguggaagagcgccagagaggccguggaggacagcagauucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacauggagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcguguucaagaacauccagcaccugaccgugaccgaggagguggccgugcagaacuggcuggccagagugggcagagagagacugagcagaauggccaucagcggcgacgacugcguggugaagccccuggacgacagauucgccaacgcccugaccgcccugaacgacaugggcaagaucagaaaggacauccagcagugggagcccagcaagggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugagagagaccgccugccugggcaagagcuacgcccagauguggagccugauguacuuccacagaagagaccugagacuggccgccaacgccaucugcagcgccgugcccagccacugggugcccaccagcagaaccaccuggagcauccacgccaagcacgaguggaugaccaccgaggacaugcugaccguguggaacagaguguggaucagagagaaccccuggauggaggacaagacccccguggagagcugggaggagauccccuaccugggcaagagagaggaccaguggugcggcagccugaucggccugaccagcagagccaccugggccaagaacauccaggccgccaucaaccaggugagaagccugaucggcaacgaggaguacaccgacuacaugcccagcaugaagagauucagaagagaggaggaggaggccggcgugcugugguga

SEQ ID NO: 17490 - RNA, 9876 nt, Artificial Sequence
  derived and/or modified CDS sequence (opt4) from DENV-2__EU482774__SS-prME
agcgccggcaugaucaucaugcugauccccaccgugauggccuuccaccugaccaccagaaacggcgagccccacaugaucgugggcauccaggagaagggcaagagccugcuguucaagaccgaggacggcgugaacaugugcacccugauggccauggaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgcccagagaaucgagaccuggauccugagacaccccggcuucaccaucauggccgccauccuggccuacaccaucggcaccacccacuuccagagagugcugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaaggaggagcaggacaagagauucgugugcaagcacagcaugguggacagaggcuggggcaacggcugcggccuguucggcaagggcggcaucgugaccugcgccauguucaccugcaagaagaacauggagggcaagaucgugcagcccgagaaccuggaguacaccaucguggugaccccccacagcggcgaggagcacgccgugggcaacgacaccggcaagcacggcaaggagaucaaggugaccccccagagcagcaucaccgaggccgagcugaccggcuacggcaccgugaccauggagugcagccccagaaccggccuggacuucaacgagauggugcugcugcagauggagaacaaggccuggcuggugcacagacagugguuccuggaccugccccugcccuggcugcccggcgccgacaagcaggagagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucgugaucagagugcaguacgagggcgacggcagccccugcaagauccccuucgagaucauggaccuggagaagagauacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagaucuucaucggcgugaucaucaccuggaucggcaugaacagcagaagcaccagccugagcgugagccuggugcuggugggcaucgugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccaggaggagggcaucugcggcaucagaagcgugaccagacuggagaaccugauguggaagcagaucacccccgagcugaaccacauccuggccgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucaccaccaacaucuggcugaagcugaaggagaagcaggacgccuucugcgacagcaagcugaugagcgccgccaucaaggacaacagagccgugcacgccgacaugggcuacuggaucgagagcgcccugaacgacaccuggaagaucgagaaggccagcuucaucgaggugaagaacugccacuggcccaagagccacacccuguggagcaacggcgugcuggagagcgagaugaucauccccaagaaccuggccggccccgugagccagcacaacuacagacccggcuaccacacccagaucgccggccccuggcaccugggcaagcuggagauggacuucgacuucugcgacggcaccaccgugaucgugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagguggacaacuucagccugggcgugcugggcauggcccuguuccuggaggagaugcugagaaccagagugggcaccaagcacgccauccugcugguggccgugagcuucgugacccugaucaccggcaacaugagcuucaaggaccugggcagagugguggugauggugggcgccaccauggccgacgacaucggcaugggcgugaccuaccuggcccugcuggccgccuucaaggugagacccaccuucgccgccggccugcugcugagaaagcugaccagcaaggagcugaugaugaccaccaucggcaucgugcugcugagccagagcaccauccccgagaccgugcuggagcugaccgacgcccuggcccugggcaugauggugcugaagaucgugagaaacauggagaaguaccagcuggccgugaccaucauggccauccugugcgugcccaacgccguggugcugcagaacgccuggaaggugagcugcaccauccuggccguggugagcgugagcccccugcugcugaccagcagccagcagaagaccgacuggaucccccuggcccugaccaucaagggccugaaccccaccgccaucuuccugaccacccugagcagaaccaacaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccaccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggccuguuccccaucagcauccccaucaccgccgccgccugguaccugugggaggugaagaagcagagagccggcgugcugugggacgugcccagccccccccccaugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacaagggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucaucgacaagaagggcaagguggugggccuguacggcaacggcguggugaccagaagcggcgccuacgugagcgccaucgcccagaccgagaagagcaucgaggacaaccccgagaucgaggacgacaucuucagaaagagaagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucaaggccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucaucgacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaagauggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaagaccagagacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcagaggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucgccacccagcagcccgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggaccccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaucccccccgagaagugcgacacccugcugugcgacaucggcgagagcagccccaaccccaccguggaggccggcagaacccugagagugcugaaccugguggagaacuggcugaacaacaacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccagcggcaacaucgugagcagcgugaacaugaucagcagaaugcugaucaacagauucaccaugagacacaagaaggccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacgugcugcccaccgugacccagauggccaugaccgacaccacccccuucggccagcagagaguguucaaggagaagguggacaccagaacccaggagcccaaggagggcaccaagaagcugaugaagaucaccgccaaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcagauucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacauggagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcguguucaagaacauccagcaccugaccgugaccgaggagguggccgugcagaacuggcuggccagagugggcagagagagacugagcagaauggccaucagcggcgacgacugcguggugaagccccuggacgacagauucgccaacgcccugaccgcccugaacgacaugggcaagaucagaaaggacauccagcagugggagcccagcaagggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugagagagaccgccugccugggcaagagcuacgcccagauguggagccugauguacuuccacagaagagaccugagacuggccgccaacgccaucugcagcgccgugcccagccacugggugcccaccagcagaaccaccuggagcauccacgccaagcacgaguggaugaccaccgaggacaugcugaccguguggaacagaguguggaucagagagaaccccuggauggaggacaagacccccguggagagcugggaggagauccccuaccugggcaagagagaggaccaguggugcggcagccugaucggccugaccagcagagccaccugggccaagaacauccaggccgccaucaaccaggugagaagccugaucggcaacgaggaguacaccgacuacaugcccagcaugaagagauucagaagagaggaggaggaggccggcgugcugugguga

SEQ ID NO: 17491 - RNA, 9876 nt, Artificial Sequence
  derived and/or modified CDS sequence (opt4) from DENV-2__EU482775__SS-prME
agcgccggcaugaucaucaugcugauccccaccgugauggccuuccaccugaccaccagaaacggcgagccccacaugaucgugggcauccaggagaagggcaagagccugcuguucaagaccgaggacggcgugaacaugugcacccugauggccauggaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgcccagagaaucgagaccuggauccugagacaccccggcuucaccaucauggccgccauccuggccuacaccaucggcaccacccacuuccagagagugcugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaaggaggagcaggacaagagauucgugugcaagcacagcaugguggacagaggcuggggcaacggcugcggccuguucggcaagggcggcaucgugaccugcgccauguucaccugcaagaagaacauggagggcaagaucgugcagcccgagaaccuggaguacaccaucguggugaccccccacagcggcgaggagcacgccgugggcaacgacaccggcaagcacggcaaggagaucaaggugaccccccagagcagcaucaccgaggccgagcugaccggcuacggcaccgugaccauggagugcagccccagaaccggccuggacuucaacgagauggugcugcugcagauggagaacaaggccuggcuggugcacagacagugguuccuggaccugccccugcccuggcugcccggcgccgacaagcaggagagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucgugaucagagugcaguacgagggcgacggcagccccugcaagauccccuucgagaucauggaccuggagaagagauacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcaucgugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccaggaggagggcaucugcggcaucagaagcgugaccagacuggagaaccugauguggaagcagaucacccccgagcugaaccacauccuggccgagaacgaggugaagcugaccaucaugaccggcgacaucagaggcaucaugcaggccggcaagagaagccugagaccccagcccaccgagcugaaguacagcuggaagaccuggggcaaggccaagaugcugagcaccgagagcuacaaccagaccuuccugaucgacggccccgagaccgccgagugccccaacaccaacagagccuggaacagccuggagguggaggacuacggcuucggcguguucaccaccaacaucuggcugaagcugaaggagaagcaggacgccuucugcgacagcaagcugaugagcgccgccaucaaggacaacagagccgugcacgccgacaugggcuacuggaucgagagcgcccugaacgacaccuggaagaucgagaaggccagcuucaucgaggugaagaacugccacuggcccaagagccacacccuguggagcaacggcgugcuggagagcgagaugaucauccccaagaaccuggccggccccgugagccagcacaacuacagacccggcuaccacacccagaucgccggccccuggcaccugggcaagcuggagauggacuucgacuucugcgacggcaccaccgugaucgugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagguggacaacuucagccugggcgugcugggcauggcccuguuccuggaggagaugcugagaaccagagugggcaccaagcacgccauccugcugguggccgugagcuucgugacccugaucaccggcaacaugagcuucaaggaccugggcagagugguggugauggugggcgccaccauggccgacgacaucggcaugggcgugaccuaccuggcccugcuggccgccuucaaggugagacccaccuucgccgccggccugcugcugagaaagcugaccagcaaggagcugaugaugaccaccaucggcaucgugcugcugagccagagcaccauccccgagaccgugcuggagcugaccgacgcccuggcccugggcaugauggugcugaagaucgugagaaacauggagaaguaccagcuggccgugaccaucauggccauccugugcgugcccaacgccgugauccugcagaacgccuggaaggugagcugcaccauccuggccguggugagcgugagcccccugcugcugaccagcagccagcagaagaccgacuggaucccccuggcccugaccaucaagggccugaaccccaccgccaucuuccugaccacccugagcagaaccaacaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccaccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggccuguuccccaucagcauccccaucaccgccgccgccugguaccugugggaggugaagaagcagagagccggcgugcugugggacgugcccagccccccccccaugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacaagggcaagagaaucgagcccagcugggccgacgugagaaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucaucgacaagaagggcaagguggugggccuguacggcaacggcguggugaccagaagcggcgccuacgugagcgccaucgcccagaccgagaagagcaucgaggacaaccccgagaucgaggacgacaucuucagaaagagaagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucaucgacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaagauggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaagaccagagacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcagaggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucgccacccagcagcccgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggaccccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaucccccccgagaagugcgacacccugcugugcgacaucggcgagagcagccccaaccccaccguggaggccggcagaacccugagagugcugaaccugguggagaacuggcugaacaacaacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccagcggcaacaucgugagcagcgugaacaugaucagcagaaugcugaucaacagauucaccaugagacacaagaaggccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacgugcugcccaccgugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcagauucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacauggagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcguguucaagaacauccagcaccugaccgugaccgaggagguggccgugcacaacuggcuggccagagugggcagagagagacugagcagaauggccaucagcggcgacgacugcguggugaagccccuggacgacagauucgccaacgcccugaccgcccugaacgacaugggcaagaucagaaaggacauccagcagugggagcccagcaagggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugagagagaccgccugccugggcaagagcuacgcccagauguggagccugauguacuuccacagaagagaccugagacuggccgccaacgccaucugcagcgccgugcccagccacugggugcccaccagcagaaccaccuggagcauccacgccaagcacgaguggaugaccaccgaggacaugcugaccguguggaacagaguguggaucagagagaaccccuggauggaggacaagacccccguggagagcugggaggagauccccuaccugggcaagagagaggaccaguggugcggcagccugaucggccugaccagcagagccaccugggccaagaacauccaggccgccaucaaccaggugagaagccugaucggcaacgaggaguacaccgacuacaugcccagcaugaagagauucagaagagaggaggaggaggccggcgugcugugguga

SEQ ID NO: 17492 - RNA, 9876 nt, Artificial Sequence
  derived and/or modified CDS sequence (opt4) from DENV-2__EU482776__SS-prME
agcgccggcaugaucaucaugcugauccccaccgugauggccuuccaccugaccaccagaaacggcgagccccacaugaucgugggcauccaggagaagggcaagagccugcuguucaagaccgaggacggcgugaacaugugcacccugauggccauggaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgcccagagaaucgagaccuggauccugagacaccccggcuucaccaucauggccgccauccuggccuacaccaucggcaccacccacuuccagagagugcugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaaggaggagcaggacaagagauucgugugcaagcacagcaugguggacagaggcuggggcaacggcugcggccuguucggcaagggcggcaucgugaccugcgccauguucaccugcaagaagaacauggagggcaagaucgugcagcccgagaaccuggaguacaccaucguggugaccccccacagcggcgaggagcacgccgugggcaacgacaccggcaagcacggcaaggagaucaaggugaccccccagagcagcaucaccgaggccgagcugaccggcuacggcaccgugaccauggagugcagccccagaaccggccuggacuucaacgagauggugcugcugcagauggagaacaaggccuggcuggugcacagacagugguuccuggaccugccccugcccuggcugcccggcgccgacaagcaggagagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucgugaucagagugcaguacgagggcgacggcagccccugcaagauccccuucgagaucauggaccuggagaagagauacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcaucgugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccaggaggagggcaucugcggcaucagaagcgugaccagacuggagaaccugauguggaagcagaucacccccgagcugaaccacauccuggccgagaacgaggugaagcugaccaucaugaccggcgacaucagaggcaucaugcaggccggcaagagaagccugagaccccagcccaccgagcugaaguacagcuggaagaccuggggcaaggccaagaugcugagcaccgagagcuacaaccagaccuuccugaucgacggccccgagaccgccgagugccccaacaccaacagagccuggaacagccuggagguggaggacuacggcuucggcguguucaccaccaacaucuggcugaagcugaaggagaagcaggacgccuucugcgacagcaagcugaugagcgccgccaucaaggacaacagagccgugcacgccgacaugggcuacuggaucgagagcgcccugaacgacaccuggaagaucgagaaggccagcuucaucgaggugaagaacugccacuggcccaagagccacacccuguggagcaacggcgugcuggagagcgagaugaucauccccaagaaccuggccggccccgugagccagcacaacuacagacccggcuaccacacccagaucgccggccccuggcaccugggcaagcuggagauggacuucgacuucugcgacggcaccaccgugaucgugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagguggacaacuucagccugggcgugcugggcauggcccuguuccuggaggagaugcugagaaccagagugggcaccaagcacgccauccugcugguggccgugagcuucgugacccugaucaccggcaacaugagcuucaaggaccugggcagagugguggugauggugggcgccaccauggccgacgacaucggcaugggcgugaccuaccuggcccugcuggccgccuacaaggugagacccaccuucgccgccggccugcugcugagaaagcugaccagcaaggagcugaugaugaccaccaucggcaucgugcugcugagccagagcaccauccccgagaccgugcuggagcugaccgacgcccuggcccugggcaugauggugcugaagaucgugagaaacauggagaaguaccagcuggccgugaccaucauggccauccugugcgugcccaacgccgugauccugcagaacgccuggaaggccagcugcaccauccuggccguggugagcgugagcccccugcugcugaccagcagccagcagaagaccgacuggaucccccuggcccugaccaucaagggccugaaccccaccgccaucuuccugaccacccugagcagaaccaacaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccaccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggccuguuccccaucagcauccccaucaccgccgccgccugguaccugugggaggugaagaagcagagagccggcgugcugugggacgugcccagccccccccccaugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacaagggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucaucgacaagaagggcaagguggugggccuguacggcaacggcguggugaccagaagcggcgccuacgugagcgccaucgcccagaccgagaagagcaucgaggacaaccccgagaucgaggacgacaucuucagaaagagaagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucaucgacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaagauggugcuucgacggcaucaagaacaaccagauccuggaggagaacauggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaagaccagagacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcagaggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucgccacccagcagcccgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggaccccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaucccccccgagaagugcgacacccugcugugcgacaucggcgagagcagccccaaccccaccguggaggccggcagaacccugagaauccugaaccugguggagaacuggcugaacaacaacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccagcggcaacaucgugagcagcgugaacaugaucagcagaaugcugaucaacagauucaccaugagacacaagaaggccaccuacgagcccgacguggaccugggcagcggcaccagaaacaucggcaucgagagcgagauccccaaccuggacaucaucggcaagagaaucgagaagaucaagcaggagcacgaggccagcuggcacuacgaccaggaccaccccuacaagaccugggccuaccacggcagcuacgagaccaagcagaccggcagcgccagcagcauggugaacggcguggugagacugcugaccaagcccugggacgugcugcccaccgugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcagauucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacauggagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcguguucaagaacauccagcaccugaccgugaccgaggagguggccgugcacaacuggcuggccagagugggcugcgagagacugagcagaauggccaucagcggcgacgacugcguggugaagccccuggacgacagauucgccaacgcccugaccgcccugaacgacaugggcaagaucagaaaggacauccagcagugggagcccagcaagggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugagagagaccgccugccugggcaagagcuacgcccagauguggagccugauguacuuccacagaagagaccugagacuggccgccaacgccaucugcagcgccgugcccagccacugggugcccaccagcagaaccaccuggagcauccacgccaagcacgaguggaugaccaccgaggacaugcugaccguguggaacagaguguggauccuggagaaccccuggauggaggacaagacccccguggagagcugggaggagauccccuaccugggcaagagagaggaccaguggugcggcagccugaucggccugaccagcagagccaccugggccaagaacauccaggccgccaucaaccaggugagaagccugaucggcaacgaggaguacaccgacuacaugcccagcaugaagagauucagaagagaggaggaggaggccggcgugcugugguga

SEQ ID NO: 17493 - RNA, 9876 nt, Artificial Sequence
  derived and/or modified CDS sequence (opt4) from DENV-2__EU482777__SS-prME
agcgccggcaugaucaucaugcugauccccaccgugauggccuuccaccugaccaccagaaacggcgagccccacaugaucgugggcauccaggagaagggcaagagccugcuguucaagaccgaggacggcgugaacaugugcacccugauggccauggaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgcccagagaaucgagaccuggauccugagacaccccggcuucaccaucauggccgccauccuggccuacaccaucggcaccacccacuuccagagagugcugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaaggaggagcaggacaagagauucgugugcaagcacagcaugguggacagaggcuggggcaacggcugcggccuguucggcaagggcggcaucgugaccugcgccauguucaccugcaagaagaacauggagggcaagaucgugcagcccgagaaccuggaguacaccaucguggugaccccccacagcggcgaggagcacgccgugggcaacgacaccggcaagcacggcaaggagaucaaggugaccccccagagcagcaucaccgaggccgagcugaccggcuacggcaccgugaccauggagugcagccccagaaccggccuggacuucaacgagauggugcugcugcagauggagaacaaggccuggcuggugcacagacagugguuccuggaccugccccugcccuggcugcccggcgccgacaagcaggagagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucgugaucagagugcaguacgagggcgacggcagccccugcaagauccccuucgagaucauggaccuggagaagagauacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcaucgugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccaggaggagggcaucugcggcaucagaagcgugaccagacuggagaaccugauguggaagcagaucacccccgagcugaaccacauccuggccgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagcuacaaccagaccuuccugaucgacggccccgagaccgccgagugccccaacaccaacagagccuggaacagccuggagguggaggacuacggcuucggcguguucaccaccaacaucuggcugaagcugaaggagaagcaggacgccuucugcgacagcaagcugaugagcgccgccaucaaggacaacagagccgugcacgccgacaugggcuacuggaucgagagcgcccugaacgacaccuggaagaucgagaaggccagcuucaucgaggugaagaacugccacuggcccaagagccacacccuguggagcaacggcgugcuggagagcgagaugaucauccccaagaaccuggccggccccgugagccagcacaacuacagacccggcuaccacacccagaucgccggccccuggcaccugggcaagcuggagauggacuucgacuucugcgacggcaccaccgugaucgugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagguggacaacuucagccugggcgugcugggcauggcccuguuccuggaggagaugcugagaaccagagugggcaccaagcacgccauccugcugguggccgugagcuucgugacccugaucaccggcaacaugagcuucaaggaccugggcagagugguggugauggugggcgccaccauggccgacgacaucggcaugggcgugaccuaccuggcccugcuggccgccuucaaggugagacccaccuucgccgccggccugcugcugagaaagcugaccagcaaggagcugaugaugaccaccaucggcaucgugcugcugagccagagcaccauccccgagaccgugcuggagcugaccgacgcccuggcccugggcaugauggugcugaagaucgugagaaacauggagaaguaccagcuggccgugaccaucauggccauccugugcgugcccaacgccgugauccugcagaacgccuggaaggugagcugcaccauccuggccguggugagcgugagcccccugcugcugaccagcagccagcagaagaccgacuggaucccccuggcccugaccaucaagggccugaaccccaccgccaucuuccugaccacccugagcagaaccaacaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccaccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggccuguuccccaucagcauccccaucaccgccgccgccugguaccugugggaggugaagaagcagagagccggcgugcugugggacgugcccagccccccccccaugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacaagggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucaucgacaagaagggcaagguggugggccuguacggcaacggcguggugaccagaagcggcgccuacgugagcgccaucgcccagaccgagaagagcaucgaggacaaccccgagaucgaggacgacaucuucagaaagagaagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucaucgacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaagauggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaagaccagagacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcagaggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucgccacccagcagcccgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggaccccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaugggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaucccccccgagaagugcgacacccugcugugcgacaucggcgagagcagccccaaccccaccguggaggccggcagaacccugagagugcugaaccugguggagaacuggcugaacaacaacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccagcggcaacaucgugagcagcgugaacaugaucagcagaaugcugaucaacagauucaccaugagacacaagaaggccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacgugcugcccaccgugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcagauucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacauggagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcguguucaagaacauccagcaccugaccgugaccgaggagguggccgugcagaacuggcuggccagagugggcagagagagacugagcagaauggccaucagcggcgacgacugcguggugaagccccuggacgacagauucgccaacgcccugaccgcccugaacgacaugggcaagaucagaaaggacauccagcagugggagcccagcaagggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugagagagaccgccugccugggcaagagcuacgcccagauguggagccugauguacuuccacagaagagaccugagacuggccgccaacgccaucugcagcgccgugcccagccacugggugcccaccagcagaaccaccuggagcauccacgccaagcacgaguggaugaccaccgaggacaugcugaccguguggaacagaguguggaucagagagaaccccuggauggaggacaagacccccguggagagcugggaggagauccccuaccugggcaagagagaggaccaguggugcggcagccugaucggccugaccagcagagccaccugggccaagaacauccaggccgccaucaaccaggugagaagccugaucggcaacgaggaguacaccgacuacaugcccagcaugaagagauucagaagagaggaggaggaggccggcgugcugugguga

SEQ ID NO: 17494 - RNA, 9876 nt, Artificial Sequence
  derived and/or modified CDS sequence (opt4) from DENV-2__EU482778__SS-prME
accgccggcgugaucaucaugcugauccccaccgccauggccuuccaccugaccaccagaaacggcgagccccacaugaucgugggcagacaggagaagggcaagagccugcuguucaagaccgaggacggcgugaacaugugcacccugauggccaucgaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgcccagagaaucgagaccuggauccugagacaccccggcuucaccaucauggccgccauccuggccuacaccgugggcaccacccacuuccagagagcccugaucuucauccugcuggccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaacgaggagcaggacaagagauucgugugcaagcacagcaugguggacagaggcuggggcaacggcugcggccuguucggcaagggcggcaucgugaccugcgccauguucaccugcaagaagaacauggagggcaagaucgugcagcccgagaaccuggaguacaccaucgugaucaccccccacagcggcgaggagcacgccgugggcaacgacaccggcaagcacggcaaggagaucaagaucaccccccagagccccaucaccgaggccgagcugaccggcuacggcaccgugaccauggagugcagccccagaaccggccuggacuucaacgagauggugcugcugcagauggaggacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagaucgugaaggagaucgccgagacccagcacggcaccaucgugaucagagugcaguacgagggcgacggcagccccugcaagauccccuucgagaucauggaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcgugaucacccuguaccugggcgccauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucaccaccaacaucuggcugaagcugagagagaagcaggacguguucugcgacagcaagcugaugagcgccgccaucaaggacaacagagccgugcacgccgacaugggcuacuggaucgagagcgcccugaacgacaccuggaagauggagaaggccagcuucaucgaggugaagaacugccacuggcccaagagccacacccuguggagcaacggcgugcuggagagcgagaugaucauccccaagagcuucgccggccccgugagccagcacaacuacagacccggcuacuacacccagaccgccggccccuggcaccugggcaagcuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugguggccgugagcuucgugacccugaucaccggcaacaugagcuucagagaccugggcagagugauggugauggugggcgccgccaugaccgacgacaucggcaucggcgugaccuaccuggcccugcuggccgccuucaaggugagacccaccuucgccgccggccugcugcugagaaagcugaccagcaaggagcugaugauggccaccaucggcaucgcccugcugagccagagcaccauccccgagaccauccuggagcugaccgacgcccuggcccugggcaugauggugcugaagaucgugagaaacauggagaaguaccagcuggccgugaccaucauggccaucagcugcgugcccaacgccgugauccugcagaacgccuggaaggugagcugcaccauccuggccaccgugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccaccgacgugaagugggaggaccaggccgagaucagcggcagcagccccauccugagcaucaccaucgccgaggacggcagcaugagcaucaagaacgaggaggaggagcagacccugaccauccugaucagaaccggccugcuggugaucagcggccuguuccccgugagcauccccaucaccgccgccgccugguaccugugggaggugaagaagcagagagccggcgugcugugggacgugcccagccccccccccgugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacagaggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucguggacaagaagggcaagguggugggccuguacggcaacggcguggugaccagaagcggcgccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacagaguggccgccgagggcaucaacuacgccgacagaagauggugcuucgacggcgugaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagagacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcgugggcaagaugacccugggcaugugcugcaucaucaccgccagcauccugcuguggcacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucgccacccaggagcccgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggaccccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccgugcccaugagcaccuacggcuggaaccuggugagacugcagagcggcguggacguguucuucaccccccccgagaagugcgacacccugcugugcgacaucggcgagagcagccccaaccccaccaucgaggccggcagaacccugagagugcugagccugguggagaacuggcugaacaacgacacccaguucugcaucaaggugcugaaccccuacaugcccagcgugaucgagaagauggagacccugcagagaaaguacggcggcgcccuggugagaaacccccugagcagaaacagcacccacgagauguacugggugagcaacgccaccggcaacaucgugagcagcgugaacaugaucagcagaaugcugaucaacagauucaccaugaagcacaagaaggccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacguggugcccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcagauucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacauggagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcaucuucaagagcauccagcaccugaccgugaccgaggagaucgccgugcagaacuggcuggccagagugggcagagagagacugagcagaauggccaucagcggcgacgacugcguggugaagccccuggacgacagauucgccagcgcccugaccgcccugaacgacaugggcaaggugagaaaggacauccagcagugggagcccagcagaggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugaaggagaccgccugccugggcaagagcuacgcccagauguggagccugauguacuuccacagaagagaccugagacuggccgccaacgccaucugcagcgccgugcccagccacugggugcccaccagcagaaccaccuggagcauccacgccaagcacgaguggaugaccaccgaggacaugcugaccguguggaacagaguguggauccaggagaaccccuggauggaggacaagacccccguggagagcugggaggaggugcccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 17495 - RNA, 9876 nt, Artificial Sequence
  derived and/or modified CDS sequence (opt4) from DENV-2__EU482779__SS-prME
accgccggcgugaucaucaugcugauccccaccgccauggccuuccaccugaccaccagaaacggcgagccccacaugaucgugggcagacaggagaagggcaagagccugcuguucaagaccgaggacggcgugaacaugugcacccugauggccaucgaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgcccagagaaucgagaccuggauccugagacaccccggcuucaccaucauggccgccauccuggccuacaccgugggcaccacccacuuccagagagcccugaucuucauccugcuggccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaacgaggagcaggacaagagauucgugugcaagcacagcaugguggacagaggcuggggcaacggcugcggccuguucggcaagggcggcaucgugaccugcgccauguucaccugcaagaagaacauggagggcaagaucgugcagcccgagaaccuggaguacaccaucgugaucaccccccacagcggcgaggagcacgccgugggcaacgacaccggcaagcacggcaaggagaucaagaucaccccccagagccccaucaccgaggccgagcugaccggcuacggcaccgugaccauggagugcagccccagaaccggccuggacuucaacgagauggugcugcugcagauggaggacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagaucgugaaggagaucgccgagacccagcacggcaccaucgugaucagagugcaguacgagggcgacggcagccccugcaagauccccuucgagaucauggaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcgugaucacccuguaccugggcgccauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucaccaccaacaucuggcugaagcugagagagaagcaggacguguucugcgacagcaagcugaugagcgccgccaucaaggacaacagagccgugcacgccgacaugggcuacuggaucgagagcgcccugaacgacaccuggaagauggagaaggccagcuucaucgaggugaagagcugccacuggcccaagagccacacccuguggagcaacggcgugcuggagagcgagaugaucauccccaagagcuucgccggccccgugagccagcacaacuacagacccggcuacuacacccagaccgccggccccuggcaccugggcaagcuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcuggugaccgugagcuucgugacccugaucaccggcaacaugagcuucagagaccugggcagagugauggugauggugggcgccgccaugaccgacgacaucggcaugggcgugaccuaccuggcccugcuggccgccuucaaggugagacccaccuucgccgccggccugcugcugagaaagcugaccagcaaggagcugaugauggccaccaucggcaucgcccugcugagccagagcaccauccccgagaccauccuggagcugaccgacgcccuggcccugggcaugauggugcugaagaucgugagaaacauggagaaguaccagcuggccgugaccaucauggccaucagcugcgugcccaacgccgugauccugcagaacgccuggaaggugagcugcaccauccuggccgccgugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccaccgacgugaagugggaggaccaggccgagaucagcggcagcagccccauccugagcaucaccaucgccgaggacggcagcaugagcaucaagaacgaggaggaggagcagacccugaccauccugaucagaaccggccugcuggugaucagcggccuguuccccgugagcauccccaucaccgccgccgccugguaccugugggaggugaagaagcagagagccggcgugcugugggacgugcccagccccccccccgugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacagaggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucguggacagaaagggcaagguggugggccuguacggcaacggcguggugaccagaagcggcgccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacagaguggccgccgagggcaucaacuacgccgacagaagauggugcuucgacggcgugaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagagacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcgugggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucgccacccaggagcccgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcgugaccgugaucgaccuggaccccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaaggacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccaucgaggccggcagaacccugagagugcugagccugguggagaacuggcugaacaacgacacccaguucugcaucaaggugcugaaccccuacaugcccagcgugaucgagaagauggagacccugcagagaaaguacggcggcgcccuggugagaaacccccugagcagaaacagcacccacgagauguacugggugagcaacgccaccggcaacaucgugagcagcgugaacaugaucagcagaaugcugaucaacagauucaccaugaagcacaagaaggccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacguggugcccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcagauucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacauggagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcguguucaagagcauccagagacugaccgugaccgaggagaucgccgugcagaacuggcuggccagagugggcagagagagacugagcagaauggccaucagcggcgacgacugcguggugaagccccuggacgacagauucgccagcgcccugaccgcccugaacgacaugggcaaggugagaaaggacauccagcagugggagcccagcagaggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugaaggagaccgccugccugggcaagagcuacgcccagauguggagccugauguacuuccacagaagagaccugagacuggccgccaacgccaucugcagcgccgugcccagccacugggugcccaccagcagaaccaccuggagcauccacgccaagcacgaguggaugaccaccgaggacaugcugaccguguggaacagaguguggauccaggagaaccccuggauggaggacaagacccccguggagagcugggaggaggugcccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 17496 - RNA, 9876 nt, Artificial Sequence
  derived and/or modified CDS sequence (opt4) from DENV-2__EU482780__SS-prME
accgccggcgugaucaucaugcugauccccaccgccauggccuuccaccugaccaccagaaacggcgagccccacaugaucgugggcagacaggagaagggcaagagccugcuguucaagaccgaggacggcgugaacaugugcacccugauggccaucgaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgcccagagaaucgagaccuggauccugagacaccccggcuucaccaucauggccgccauccuggccuacaccgugggcaccacccacuuccagagagcccugaucuucauccugcuggccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaacgaggagcaggacaagagauucgugugcaagcacagcaugguggacagaggcuggggcaacggcugcggccuguucggcaagggcggcaucgugaccugcgccauguucaccugcaagaagaacauggagggcaagaucgugcagcccgagaaccuggaguacaccaucgugaucaccccccacagcggcgaggagcacgccgugggcaacgacaccggcaagcacggcaaggagaucaagaucaccccccagagccccaucaccgaggccgagcugaccggcuacggcaccgugaccauggagugcagccccagaaccggccuggacuucaacgagauggugcugcugcagauggaggacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagaucgugaaggagaucgccgagacccagcacggcaccaucgugaucagagugcaguacgagggcgacggcagccccugcaagauccccuucgagaucauggaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcgugaucacccuguaccugggcgccauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucaccaccaacaucuggcugaagcugagagagaagcaggacguguucugcgacagcaagcugaugagcgccgccaucaaggacaacagagccgugcacgccgacaugggcuacuggaucgagagcgcccugaacgacaccuggaagauggagaaggccagcuucaucgaggugaagagcugccacuggcccaagagccacacccuguggagcaacggcgugcuggagagcgagaugaucauccccaagagcuucgccggccccgugagccagcacaacuacagacccggcuacuacacccagaccgccggccccuggcaccugggcaagcuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcuggugaccgugagcuucgugacccugaucaccggcaacaugagcuucagagaccugggcagagugauggugauggugggcgccgccaugaccgacgacaucggcaugggcgugaccuaccuggcccugcuggccgccuucaaggugagacccaccuucgccgccggccugcugcugagaaagcugaccagcaaggagcugaugauggccaccaucggcaucgcccugcugagccagagcaccauccccgagaccauccuggagcugaccgacgcccuggcccugggcaugauggugcugaagaucgugagaaacauggagaaguaccagcuggccgugaccaucauggccaucagcugcgugcccaacgccgugauccugcagaacgccuggaaggugagcugcaccauccuggccgccgugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccaccgacgugaagugggaggaccaggccgagaucagcggcagcagccccauccugagcaucaccaucgccgaggacggcagcaugagcaucaagaacgaggaggaggagcagacccugaccauccugaucagaaccggccugcuggugaucagcggccuguuccccgugagcauccccaucaccgccgccgccugguaccugugggaggugaagaagcagagagccggcgugcugugggacgugcccagccccccccccgugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacagaggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucguggacagaaagggcaagguggugggccuguacggcaacggcguggugaccagaagcggcgccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacagaguggccgccgagggcaucaacuacgccgacagaagauggugcuucgacggcgugaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagagacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcgugggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucgccacccaggagcccgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcgugaccgugaucgaccuggaccccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaaggacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccaucgaggccggcagaacccugagagugcugagccugguggagaacuggcugaacaacgacacccaguucugcaucaaggugcugaaccccuacaugcccagcgugaucgagaagauggagacccugcagagaaaguacggcggcgcccuggugagaaacccccugagcagaaacagcacccacgagauguacugggugagcaacgccaccggcaacaucgugagcagcgugaacaugaucagcagaaugcugaucaacagauucaccaugaagcacaagaaggccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacguggugcccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcagauucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacauggagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcguguucaagagcauccagagacugaccgugaccgaggagaucgccgugcagaacuggcuggccagagugggcagagagagacugagcagaauggccaucagcggcgacgacugcguggugaagccccuggacgacagauucgccagcgcccugaccgcccugaacgacaugggcaaggugagaaaggacauccagcagugggagcccagcagaggcuggaacgacuggacccaggugcccuucugcagccaccacuuccacgagcugaucaugaaggacggcagaaugcugguggugcccugcagaaaccaggacgagcugaucggcagagccagaaucagccagggcgccggcuggagccugaaggagaccgccugccugggcaagagcuacgcccagauguggagccugauguacuuccacagaagagaccugagacuggccgccaacgccaucugcagcgccgugcccagccacugggugcccaccagcagaaccaccuggagcauccacgccaagcacgaguggaugaccaccgaggacaugcugaccguguggaacagaguguggauccaggagaaccccuggauggaggacaagacccccguggagagcugggaggaggugcccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 17497 - RNA, 9876 nt, Artificial Sequence
  derived and/or modified CDS sequence (opt4) from DENV-2__EU482781__SS-prME
accgccggcgugaucaucaugcugauccccaccgccauggccuuccaccugaccaccagaaacggcgagccccacaugaucgugggcagacaggagaagggcaagagccugcuguucaagaccgaggacggcgugaacaugugcacccugauggccaucgaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgcccagagaaucgagaccuggauccugagacaccccggcuucaccaucauggccgccauccuggccuacaccgugggcaccacccacuuccagagagcccugaucuucauccugcuggccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaacgaggagcaggacaagagauucgugugcaagcacagcaugguggacagaggcuggggcaacggcugcggccuguucggcaagggcggcaucgugaccugcgccauguucaccugcaagaagaacauggagggcaagaucgugcagcccgagaaccuggaguacaccaucgugaucaccccccacagcggcgaggagcacgccgugggcaacgacaccggcaagcacggcaaggagaucaagaucaccccccagagccccaucaccgaggccgagcugaccggcuacggcaccgugaccauggagugcagccccagaaccggccuggacuucaacgagauggugcugcugcagauggaggacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagaucgugaaggagaucgccgagacccagcacggcaccaucgugaucagagugcaguacgagggcgacggcagccccugcaagauccccuucgagaucauggaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcgugaucacccuguaccugggcgccauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcagcccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucaccaccaacaucuggcugaagcugagagagaagcaggacguguucugcgacagcaagcugaugagcgccgccaucaaggacaacagagccgugcacgccgacaugggcuacuggaucgagagcgcccugaacgacaccuggaagauggagaaggccagcuucaucgaggugaagagcugccacuggcccaagagccacacccuguggagcaacggcgugcuggagagcgagaugaucauccccaagagcuucgccggccccgugagccagcacaacuacagacccggcuacuacacccagaccgccggccccuggcaccugggcaagcuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcuggugaccgugagcuucgugacccugaucaccggcaacaugagcuucagagaccugggcagagugauggugauggugggcgccgccaugaccgacgacaucggcaugggcgugaccuaccuggcccugcuggccgccuucaaggugagacccaccuucgccgccggccugcugcugagaaagcugaccagcaaggagcugaugauggccaccaucggcaucgcccugcugagccagagcaccauccccgagaccauccuggagcugaccgacgcccuggcccugggcaugauggugcugaagaucgugagaaacauggagaaguaccagcuggccgugaccaucauggccaucagcugcgugcccaacgccgugauccugcagaacgccuggaaggugagcugcaccauccuggccgccgugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccaccgacgugaagugggaggaccaggccgagaucagcggcagcagccccauccugagcaucaccaucgccgaggacggcagcaugagcaucaagaacgaggaggaggagcagacccugaccauccugaucagaaccggccugcuggugaucagcggccuguuccccgugagcauccccaucaccgccgccgccugguaccugugggaggugaagaagcagagagccggcgugcugugggacgugcccagccccccccccgugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacagaggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucguggacagaaagggcaagguggugggccuguacggcaacggcguggugaccagaagcggcgccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacagaguggccgccgagggcaucaacuacgccgacagaagauggugcuucgacggcgugaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagagacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcgugggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucgccacccaggagcccgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcgugaccgugaucgaccuggaccccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaaggacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccaucgaggccggcagaacccugagagugcugagccugguggagaacuggcugaacaacgacacccaguucugcaucaaggugcugaaccccuacaugcccagcgugaucgagaagauggagacccugcagagaaaguacggcggcgcccuggugagaaacccccugagcagaaacagcacccacgagauguacugggugagcaacgccaccggcaacaucgugagcagcgugaacaugaucagcagaaugcugaucaacagauucaccaugaagcacaagaaggccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacguggugcccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcagauucuggaagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacauggagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcguguucaagagcauccagagacugaccgugaccgaggagaucgccgugcagaacuggcuggccagagugggcagagagagacugagcagaauggccaucagcggcgacgacugcguggugaagccccuggacgacagauucgccagcgcccugaccgcccugaacgacaugggcaaggugagaaaggacauccagcagugggagcccagcagaggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugaaggagaccgccugccugggcaagagcuacgcccagauguggagccugauguacuuccacagaagagaccugagacuggccgccaacgccaucugcagcgccgugcccagccacugggugcccaccagcagaaccaccuggagcauccacgccaagcacgaguggaugaccaccgaggacaugcugaccguguggaacagaguguggauccaggagaaccccuggauggaggacaagacccccguggagagcugggaggaggugcccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 17498 - RNA, 9876 nt, Artificial Sequence
  derived and/or modified CDS sequence (opt4) from DENV-2__EU482782__SS-prME
agcgccggcaugaucaucaugcugauccccaccgugauggccuuccaccugaccaccagaaacggcgagccccacaugaucgugggcauccaggagaagggcaagagccugcuguucaagaccgaggacggcgugaacaugugcacccugauggccauggaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgcccagagaaucgagaccuggauccugagacaccccggcuucaccaucauggccgccauccuggccuacaccaucggcaccacccacuuccagagagugcugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaaggaggagcaggacaagagauucgugugcaagcacagcaugguggacagaggcuggggcaacggcugcggccuguucggcaagggcggcaucgugaccugcgccauguucaccugcaagaagaacauggagggcaagaucgugcagcccgagaaccuggaguacaccaucguggugaccccccacagcggcgaggagcacgccgugggcaacgacaccggcaagcacggcaaggagaucaaggugaccccccagagcagcaucaccgaggccgagcugaccggcuacggcaccgugaccauggagugcagccccagaaccggccuggacuucaacgagauggugcugcugcagauggagaacaaggccuggcuggugcacagacagugguuccuggaccugccccugcccuggcugcccggcgccgacaagcaggagagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucgugaucagagugcaguacgagggcgacggcagccccugcaagauccccuucgagaucauggaccuggagaagagauacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcaucgugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccaggaggagggcaucugcggcaucagaagcgugaccagacuggagaaccugauguggaagcagaucacccccgagcugaaccacauccuggccgagaacgaggugaagcugaccaucaugaccggcgacaucagaggcaucaugcaggccggcaagagaagccugagaccccagcccaccgagcugaaguacagcuggaagaccuggggcaaggccaagaugcugagcaccgagagcuacaaccagaccuuccugaucgacggccccgagaccgccgagugccccaacaccaacagagccuggaacagccuggagguggaggacuacggcuucggcguguucaccaccaacaucuggcugaagcugaaggagaagcaggacgccuucugcgacagcaagcugaugagcgccgccaucaaggacaacagagccgugcacgccgacaugggcuacuggaucgagagcgcccugaacgacaccuggaagaucgagaaggccagcuucaucgaggugaagaacugccacuggcccaagagccacacccuguggagcaacggcgugcuggagagcgagaugaucauccccaagaaccuggccggccccgugagccagcacaacuacagacccggcuaccacacccagaucgccggccccuggcaccugggcaagcuggagauggacuucgacuucugcgacggcaccaccgugaucgugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagguggacaacuucagccugggcgugcugggcauggcccuguuccuggaggagaugcugagaaccagagugggcaccaagcacgccauccugcugguggccgugagcuucgugacccugaucaccggcaacaugagcuucaaggaccugggcagagugguggugauggugggcgccaccauggccgacgacaucggcaugggcgugaccuaccuggcccugcuggccgccuucaaggugagacccaccuucguggccggccugcugcugagaaagcugaccagcaaggagcugaugaugaccaccaucggcaucgugcugcugagccagagcaccauccccgagaccgugcuggagcugaccgacgcccuggcccugggcaugauggugcugaagaucgugagaaacauggagaaguaccagcuggccgugaccaucauggccauccugugcgugcccaacgccgugauccugcagaacgccuggaaggugagcugcaccauccuggccguggugagcgugagcccccugcugcugaccagcagccagcagaagaccgacuggaucccccuggcccugaccaucaagggccugaaccccaccgccaucuuccugaccacccugagcagaaccaacaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccaccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggccuguuccccaucagcauccccaucaccgccgccgccugguaccugugggaggugaagaagcagagagccggcgugcugugggacgugcccagccccccccccaugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacaagggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucaucgacaagaagggcaagguggugggccuguacggcaacggcguggugaccagaagcggcgccuacgugagcgccaucgcccagaccgagaagagcaucgaggacaaccccgagaucgaggacgacaucuucagaaagagaagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucaucgacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaagauggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaagaccagagacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcagaggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucgccacccagcagcccgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggaccccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaucccccccgagaagugcgacacccugcugugcgacaucggcgagagcagccccaaccccaccguggaggccggcagaacccugagagugcugaaccugguggagaacuggcugaacaacaacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccagcggcaacaucgugagcagcgugaacaugaucagcagaaugcugaucaacagauucaccaugagacacaagaaggccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacgugcugcccaccgugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcagauucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacauggagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcguguucaagaacauccagcaccugaccgugaccgaggagguggccgugcacaacuggcuggccagagugggcagagagagacugagcagaauggccaucagcggcgacgacugcguggugaagccccuggacgacagauucgccaacgcccugaccgcccugaacgacaugggcaagaucagaaaggacauccagcagugggagcccagcaagggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugagagagaccgccugccugggcaagagcuacgcccagauguggagccugauguacuuccacagaagagaccugagacuggccgccaacgccaucugcagcgccgugcccagccacugggugcccaccagcagaaccaccuggagcauccacgccaagcacgaguggaugaccaccgaggacaugcugaccguguggaacagaguguggaucagagagaaccccuggauggaggacaagacccccguggagagcugggaggagauccccuaccugggcaagagagaggaccaguggugcggcagccugaucggccugaccagcagagccaccugggccaagaacauccaggccgccaucaaccaggugagaagccugaucggcaacgaggaguacaccgacuacaugcccagcaugaagagauucagaagagaggaggaggaggccggcgugcugugguga

SEQ ID NO: 17499 - RNA, 9876 nt, Artificial Sequence
  derived and/or modified CDS sequence (opt4) from DENV-2__EU482783__SS-prME
accgccggcgugaucaucaugcugauccccaccgccauggccuuccaccugaccaccagaaacggcgagccccacaugaucgugggcagacaggagaagggcaagagccugcuguucaagaccgaggacggcgugaacaugugcacccugauggccaucgaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgcccagagaaucgagaccuggauccugagacaccccggcuucaccaucauggccgccauccuggccuacaccgugggcaccacccacuuccagagagcccugaucuucauccugcuggccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaacgaggagcaggacaagagauucgugugcaagcacagcaugguggacagaggcuggggcaacggcugcggccuguucggcaagggcggcaucgugaccugcgccauguucaccugcaagaagaacauggagggcaagaucgugcagcccgagaaccuggaguacaccaucgugaucaccccccacagcggcgaggagcacgccgugggcaacgacaccggcaagcacggcaaggagaucaagaucaccccccagagccccaucaccgaggccgagcugaccggcuacggcaccgugaccauggagugcagccccagaaccggccuggacuucaacgagauggugcugcugcagauggaggacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagaucgugaaggagaucgccgagacccagcacggcaccaucgugaucagagugcaguacgagggcgacggcagccccugcaagauccccuucgagaucauggaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcgugaucacccuguaccugggcgccauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcggcaucaagggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucaccaccaacaucuggcugaagcugagagagaagcaggacguguucugcgacagcaagcugaugagcgccgccaucaaggacaacagagccgugcacgccgacaugggcuacuggaucgagagcgcccugaacgacaccuggaagauggagaaggccagcuucaucgaggugaagagcugccacuggcccaagagccacacccuguggagcaacggcgugcuggagagcgagaugaucauccccaagagcuucgccggccccgugagccagcacaacuacagacccggcuacuacacccagaccgccggccccuggcaccugggcaagcuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcuggugaccgugagcuucgugacccugaucaccggcaacaugagcuucagagaccugggcagagugauggugauggugggcgccgccaugaccgacgacaucggcaugggcgugaccuaccuggcccugcuggccgccuucaaggugagacccaccuucgccgccggccugcugcugagaaagcugaccagcaaggagcugaugauggccaccaucggcaucgcccugcugagccagagcaccauccccgagaccauccuggagcugaccgacgcccuggcccugggcaugauggugcugaagaucgugagaaacauggagaaguaccagcuggccgugaccaucauggccaucagcugcgugcccaacgccgugauccugcagaacgccuggaaggugagcugcaccauccuggccgccgugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccaccgacgugaagugggaggaccaggccgagaucagcggcagcagccccauccugagcaucaccaucgccgaggacggcagcaugagcaucaagaacgaggaggaggagcagacccugaccauccugaucagaaccggccugcuggugaucagcggccuguuccccgugagcauccccaucaccgccgccgccugguaccugugggaggugaagaagcagagagccggcgugcugugggacgugcccagccccccccccgugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacagaggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucguggacagaaagggcaagguggugggccuguacggcaacggcguggugaccagaagcggcgccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacagaguggccgccgagggcaucaacuacgccgacagaagauggugcuucgacggcgugaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagagacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcgugggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucgccacccaggagcccgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggaccccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaaggacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccaucgaggccggcagaacccugagagugcugagccugguggagaacuggcugaacaacgacacccaguucugcaucaaggugcugaaccccuacaugcccagcgugaucgagaagauggagacccugcagagaaaguacggcggcgcccuggugagaaacccccugagcagaaacagcacccacgagauguacugggugagcaacgccaccggcaacaucgugagcagcgugaacaugaucagcagaaugcugaucaacagauucaccaugaagcacaagaaggccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacguggugcccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcagauucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacauggagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcguguucaagagcauccagagacugaccgugaccgaggagaucgccgugcagaacuggcuggccagagugggcagagagagacugagcagaauggccaucagcggcgacgacugcguggugaagccccuggacgacagauucgccagcgcccugaccgcccugaacgacaugggcaaggugagaaaggacauccagcagugggagcccagcagaggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugaaggagaccgccugccugggcaagagcuacgcccagauguggagccugauguacuuccacagaagagaccugagacuggccgccaacgccaucugcagcgccgugcccagccacugggugcccaccagcagaaccaccuggagcauccacgccaagcacgaguggaugaccaccgaggacaugcugaccguguggaacagaguguggauccaggagaaccccuggauggaggacaagacccccguggagagcugggaggaggugcccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 17500 - RNA, 9876 nt, Artificial Sequence
  derived and/or modified CDS sequence (opt4) from DENV-2__EU482784__SS-prME
agcgccggcaugaucaucaugcugauccccaccgugauggccuuccaccugaccaccagaaacggcgagccccacaugaucgugggcauccaggagaagggcaagagccugcuguucaagaccgaggacggcgugaacaugugcacccugauggccauggaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgcccagagaaucgagaccuggauccugagacaccccggcuucaccaucauggccgccauccuggccuacaccaucggcaccacccacuuccagagagugcugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaaggaggagcaggacaagagauucgugugcaagcacagcaugguggacagaggcuggggcaacggcugcggccuguucggcaagggcggcaucgugaccugcgccauguucaccugcaagaagaacauggagggcaagaucgugcagcccgagaaccuggaguacaccaucguggugaccccccacagcggcgaggagcacgccgugggcaacgacaccggcaagcacggcaaggagaucaaggugaccccccagagcagcaucaccgaggccgagcugaccggcuacggcaccgugaccauggagugcagccccagaaccggccuggacuucaacgagauggugcugcugcagauggagaacaaggccuggcuggugcacagacagugguuccuggaccugccccugcccuggcugcccggcgccgacaagcaggagagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucgugaucagagugcaguacgagggcgacggcagccccugcaagauccccuucgagaucauggaccuggagaagagauacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcaucgugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccaggaggagggcaucugcggcaucagaagcgugaccagacuggagaaccugauguggaagcagaucacccccgagcugaaccacauccuggccgagaacgaggugaagcugaccaucaugaccggcgacaucagaggcaucaugcaggccggcaagagaagccugagaccccagcccaccgagcugaaguacagcuggaagaccuggggcaaggccaagaugcugagcaccgagagcuacaaccagaccuuccugaucgacggccccgagaccgccgagugccccaacaccaacagagccuggaacagccuggagguggaggacuacggcuucggcguguucaccaccaacaucuggcugaagcugaaggagaagcaggacguguucugcgacagcaagcugaugagcgccgccaucaaggacagcagagccgugcacgccgacaugggcuacuggaucgagagcgcccugaacgacaccuggaagaucgagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcagacuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagaaucggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugaugaccaccaucggcaucgugcugcugagccagagcaccauccccgagaccgugcuggagcugaccgacgcccuggcccugggcaugauggugcugaagaucgugagaaacauggagaaguaccagcuggccgugaccaucauggccauccugugcgugcccaacgccgugauccugcagaacgccuggaaggugagcugcaccauccuggccguggugagcgugagcccccugcugcugaccagcagccagcagaagaccgacuggaucccccuggcccugaccaucaagggccugaaccccaccgccaucuuccugaccacccugagcagaaccaacaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccaccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggccuguuccccaucagcauccccaucaccgccgccgccugguaccugugggaggugaagaagcagagagccggcgugcugugggacgugcccagccccccccccaugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacaagggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucaucgacaagaagggcaagguggugggccuguacggcaacggcguggugaccagaagcggcgccuacgugagcgccaucgcccagaccgagaagagcaucgaggacaaccccgagaucgaggacgacaucuucagaaagagaagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucaucgacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaagauggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaagaccagagacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcagaggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucgccacccagcagcccgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggaccccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaucccccccgagaagugcgacacccugcugugcgacaucggcgagagcagccccaaccccaccguggaggccggcagaacccugagagugcugaaccugguggagaacuggcugaacaacaacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccagcggcaacaucgugagcagcgugaacaugaucagcagaaugcugaucaacagauucaccaugagacacaagaaggccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacgugcugcccaccgugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcagauucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacauggagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcguguucaagaacauccagcaccugaccgugaccgaggagguggccgugcacaacuggcuggccagagugggcagagagagacugagcagaauggccaucagcggcgacgacugcguggugaagccccuggacgacagauucgccaacgcccugaccgcccugaacgacaugggcaagaucagaaaggacauccagcagugggagcccagcaagggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugagagagaccgccugccugggcaagagcuacgcccagauguggagccugauguacuuccacagaagagaccugagacuggccgccaacgccaucugcagcgccgugcccagccacugggugcccaccagcagaaccaccuggagcauccacgccaagcacgaguggaugaccaccgaggacaugcugaccguguggaacagaguguggaucagagagaaccccuggauggaggacaagacccccguggagagcugggaggagauccccuaccugggcaagagagaggaccaguggugcggcagccugaucggccugaccagcagagccaccugggccaagaacauccaggccgccaucaaccaggugagaagccugaucggcaacgaggaguacaccgacuacaugcccagcaugaagagauucagaagagaggaggaggaggccggcgugcugugguga

SEQ ID NO: 17501 - RNA, 9876 nt, Artificial Sequence
  derived and/or modified CDS sequence (opt4) from DENV-2__EU482785__SS-prME
accgccggcgugaucaucaugcugauccccaccgccauggccuuccaccugaccaccagaaacggcgagccccacaugaucgugggcagacaggagaagggcaagagccugcuguucaagaccgaggacggcgugaacaugugcacccugauggccaucgaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgcccagagaaucgagaccuggauccugagacaccccggcuucaccaucauggccgccauccuggccuacaccgugggcaccacccacuuccagagagcccugaucuucauccugcuggccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaacgaggagcaggacaagagauucgugugcaagcacagcaugguggacagaggcuggggcaacggcugcggccuguucggcaagggcggcaucgugaccugcgccauguucaccugcaagaagaacauggagggcaagaucgugcagcccgagaaccuggaguacaccaucgugaucaccccccacagcggcgaggagcacgccgugggcaacgacaccggcaagcacggcaaggagaucaagaucaccccccagagccccaucaccgaggccgagcugaccggcuacggcaccgugaccauggagugcagccccagaaccggccuggacuucaacgagauggugcugcugcagauggaggacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagaucgugaaggagaucgccgagacccagcacggcaccaucgugaucagagugcaguacgagggcgacggcagccccugcaagauccccuucgagaucauggaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcgugaucacccuguaccugggcgccauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucaccaccaacaucuggcugaagcugagagagaagcaggacguguucugcgacagcaagcugaugagcgccgccaucaaggacaacagagccgugcacgccgacaugggcuacuggaucgagagcgcccugaacgacaccuggaagauggagaaggccagcuucaucgaggugaagagcugccacuggcccaagagccacacccuguggagcaacggcgugcuggagagcgagaugaucauccccaagagcuucgccggccccgugagccagcacaacuacagacccggcuacuacacccagaccgccggccccuggcaccugggcaagcuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcuggugaccgugagcuucgugacccugaucaccggcaacaugagcuucagagaccugggcagagugauggugauggugggcgccgccaugaccgacgacaucggcaugggcgugaccuaccuggcccugcuggccgccuucaaggugagacccaccuucgccgccggccugcugcugagaaagcugaccagcaaggagcugaugauggccaccaucggcaucgcccugcugagccagagcaccauccccgagaccauccuggagcugaccgacgcccuggcccugggcaugauggugcugaagaucgugagaaacauggagaaguaccagcuggccgugaccaucauggccaucagcugcgugcccaacgccgugauccugcagaacgccuggaaggugagcugcaccauccuggccgccgugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccaccgacgugaagugggaggaccaggccgagaucagcggcagcagccccauccugagcaucaccaucgccgaggacggcagcaugagcaucaagaacgaggaggaggagcagacccugaccauccugaucagaaccggccugcuggugaucagcggccuguuccccgugagcauccccaucaccgccgccgccugguaccugugggaggugaagaagcagagagccggcgugcugugggacgugcccagccccccccccguggagaaggccgagcuggaggacggcgccuacagaaucaagcagaagggcauccugggcuacagccagaucggcgccggcguguacaaggagggcaccuuccacaccauguggcacgugaccagaggcgccgugcugaugcacagaggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucguggacagaaagggcaagguggugggccuguacggcaacggcguggugaccagaagcggcgccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacagaguggccgccgagggcaucaacuacgccgacagaagauggugcuucgacggcgugaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagagacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcgugggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucgccacccaggagcccgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcgugaccgugaucgaccuggaccccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaaggacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccaucgaggccggcagaacccugagagugcugagccugguggagaacuggcugaacaacgacacccaguucugcaucaaggugcugaaccccuacaugcccagcgugaucgagaagauggagacccugcagagaaaguacggcggcgcccuggugagaaacccccugagcagaaacagcacccacgagauguacugggugagcaacgccaccggcaacaucgugagcagcgugaacaugaucagcagaaugcugaucaacagauucaccaugaagcacaagaaggccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacguggugcccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcagauucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacauggagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcguguucaagagcauccagagacugaccgugaccgaggagaucgccgugcagaacuggcuggccagagugggcagagagagacugagcagaauggccaucagcggcgacgacugcguggugaagccccuggacgacagauucgccagcgcccugaccgcccugaacgacaugggcaaggugagaaaggacauccagcagugggagcccagcagaggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugaaggagaccgccugccugggcaagagcuacgcccagauguggagccugauguacuuccacagaagagaccugagacuggccgccaacgccaucugcagcgccgugcccagccacugggugcccaccagcagaaccaccuggagcauccacgccaagcacgaguggaugaccaccgaggacaugcugaccguguggaacagaguguggauccaggagaaccccuggauggaggacaagacccccguggagagcugggaggaggugcccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 17502 - RNA, 9876 nt, Artificial Sequence
  derived and/or modified CDS sequence (opt4) from DENV-2__EU482786__SS-prME
agcgccggcaugaucaucaugcugauccccaccgugauggccuuccaccugaccaccagaaacggcgagccccacaugaucgugggcauccaggagaagggcaagagccugcuguucaagaccgaggacggcgugaacaugugcacccugauggccauggaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgcccagagaaucgagaccuggauccugagacaccccggcuucaccaucauggccgccauccuggccuacaccaucggcaccacccacuuccagagagugcugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaaggaggagcaggacaagagauucgugugcaagcacagcaugguggacagaggcuggggcaacggcugcggccuguucggcaagggcggcaucgugaccugcgccauguucaccugcaagaagaacauggagggcaagaucgugcagcccgagaaccuggaguacaccaucguggugaccccccacagcggcgaggagcacgccgugggcaacgacaccggcaagcacggcaaggagaucaaggugaccccccagagcagcaucaccgaggccgagcugaccggcuacggcaccgugaccauggagugcagccccagaaccggccuggacuucaacgagauggugcugcugcagauggagaacaaggccuggcuggugcacagacagugguuccuggaccugccccugcccuggcugcccggcgccgacaagcaggagagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucgugaucagagugcaguacgagggcgacggcagccccugcaagauccccuucgagaucauggaccuggagaagagauacgugcugggcagacugaucaccgugaaccccaucgugaccggcaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcaucgugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccaggaggagggcaucugcggcaucagaagcgugaccagacuggagaaccugauguggaagcagaucacccccgagcugaaccacauccuggccgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagcuacaaccagaccuuccugaucgacggccccgagaccgccgagugccccaacaccaacagagccuggaacagccuggagguggaggacuacggcuucggcguguucaccaccaacaucuggcugaagcugaaggagaagcaggacgccuucugcgacagcaagcugaugagcgccgccaucaaggacaacagagccgugcacgccgacaugggcuacuggaucgagagcgcccugaacgacaccuggaagaucgagaaggccagcuucaucgaggugaagaacugccacuggcccaagagccacacccuguggagcaacggcgugcuggagagcgagaugaucauccccaagaaccuggccggccccgugagccagcacaacuacagacccggcuaccacacccagaucgccggccccuggcaccugggcaagcuggagauggacuucgacuucugcgacggcaccaccgugaucgugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagguggacaacuucagccugggcgugcugggcauggcccuguuccuggaggagaugcugagaaccagagugggcaccaagcacgccauccugcugguggccgugagcuucgugacccugaucaccggcaacaugagcuucaaggaccugggcagagugguggugauggugggcgccaccauggccgacgacaucggcaugggcgugaccuaccuggcccugcuggccgccuucaaggugagacccaccuucgccgccggccugcugcugagaaagcugaccagcaaggagcugaugaugaccaccaucggcaucgugcugcugagccagagcaccauccccgagaccgugcuggagcugaccgacgcccuggcccugggcaugauggugcugaagaucgugagaaacauggagaaguaccagcuggccgugaccaucauggccauccugugcgugcccaacgccguggugcugcagaacgccuggaaggugagcugcaccauccuggccguggugagcgugagcccccugcugcugaccagcagccagcagaagaccgacuggaucccccuggcccugaccaucaagggccugaaccccaccgccaucuuccugaccacccugagcagaaccaacaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccaccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggccuguuccccaucagcauccccaucaccgccgccgccugguaccugugggaggugaagaagcagagagccggcgugcugugggacgugcccagccccccccccaugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacaagggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucaucgacaagaagggcaagguggugggccuguacggcaacggcguggugaccagaagcggcgccuacgugagcgccaucgcccagaccgagaagagcaucgaggacaaccccgagaucgaggacgacaucuucagaaagagaagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucaaggccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucaucgacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacggcgacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaagauggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaagaccagagacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcagaggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucgccacccagcagcccgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggaccccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaucccccccgagaagugcgacacccugcugugcgacaucggcgagagcagccccaaccccaccguggaggccggcagaacccugagagugcugaaccugguggagaacuggcugaacaacaacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccagcggcaacaucgugagcagcgugaacaugaucagcagaaugcugaucaacagauucaccaugagacacaagaaggccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacgugcugcccaccgugacccagauggccaugaccgacaccacccccuucggccagcagagaguguucaaggagaagguggacaccagaacccaggagcccaaggagggcaccaagaagcugaugaagaucaccgccaaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcagauucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacauggagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcguguucaagaacauccagcaccugaccgugaccgaggagguggccgugcagaacuggcuggccagagugggcagagagagacugagcagaauggccaucagcggcgacgacugcguggugaagccccuggacgacagauucgccaacgcccugaccgcccugaacgacaugggcaagaucagaaaggacauccagcagugggagcccagcaagggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugagagagaccgccugccugggcaagagcuacgcccagauguggagccugauguacuuccacagaagagaccugagacuggccgccaacgccaucugcagcgccgugcccagccacugggugcccaccagcagaaccaccuggagcauccacgccaagcacgaguggaugaccaccgaggacaugcugaccguguggaacagaguguggaucagagagaaccccuggauggaggacaagacccccguggagagcugggaggagauccccuaccugggcaagagagaggaccaguggugcggcagccugaucggccugaccagcagagccaccugggccaagaacauccaggccgccaucaaccaggugagaagccugaucggcaacgaggaguacaccgacuacaugcccagcaugaagagauucagaagagaggaggaggaggccggcgugcugugguga

SEQ ID NO: 17503 - RNA, 9876 nt, Artificial Sequence
  derived and/or modified CDS sequence (opt4) from DENV-2__EU482787__SS-prME
accgccggcgugaucaucaugcugauccccaccgccauggccuuccaccugaccaccagaaacggcgagccccacaugaucgugggcagacaggagaagggcaagagccugcuguucaagaccgaggacggcgugaacaugugcacccugauggccaucgaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgcccagagaaucgagaccuggauccugagacaccccggcuucaccaucauggccgccauccuggccuacaccgugggcaccacccacuuccagagagcccugaucuucauccugcuggccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaacgaggagcaggacaagagauucgugugcaagcacagcaugguggacagaggcuggggcaacggcugcggccuguucggcaagggcggcaucgugaccugcgccauguucaccugcaagaagaacauggagggcaagaucgugcagcccgagaaccuggaguacaccaucgugaucaccccccacagcggcgaggagcacgccgugggcaacgacaccggcaagcacggcaaggagaucaagaucaccccccagagccccaucaccgaggccgagcugaccggcuacggcaccgugaccauggagugcagccccagaaccggccuggacuucaacgagauggugcugcugcagauggaggacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagaucgugaaggagaucgccgagacccagcacggcaccaucgugaucagagugcaguacgagggcgacggcagccccugcaagauccccuucgagaucauggaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcgugaucacccuguaccugggcgccauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucaccaccaacaucuggcugaagcugagagagaagcaggacguguucugcgacagcaagcugaugagcgccgccaucaaggacaacagagccgugcacgccgacaugggcuacuggaucgagagcgcccugaacgacaccuggaagauggagaaggccagcuucaucgaggugaagagcugccacuggcccaagagccacacccuguggagcaacggcgugcuggagagcgagaugaucauccccaagagcuucgccggccccgugagccagcacaacuacagacccggcuacuacacccagaccgccggccccuggcaccugggcaagcuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcuggugaccgugagcuucgugacccugaucaccggcaacaugagcuucagagaccugggcagagugauggugauggugggcgccgccaugaccgacgacaucggcaugggcgugaccuaccuggcccugcuggccgccuucaaggugagacccaccuucgccgccggccugcugcugagaaagcugaccagcaaggagcugaugauggccaccaucggcaucgcccugcugagccagagcaccauccccgagaccauccuggagcugaccgacgcccuggcccugggcaugauggugcugaagaucgugagaaacauggagaaguaccagcuggccgugaccaucauggccaucagcugcgugcccaacgccgugauccugcagaacgccuggaaggugagcugcaccauccuggccgccgugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccaccgacgugaagugggaggaccaggccgagaucagcggcagcagccccauccugagcaucaccaucgccgaggacggcagcaugagcaucaagaacgaggaggaggagcagacccugaccauccugaucagaaccggccugcuggugaucagcggccuguuccccgugagcauccccaucaccgccgccgccugguaccugugggaggugaagaagcagagagccggcgugcugugggacgugcccagccccccccccgugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacagaggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccagcaccggcaccaucggcgccgugagccuggacuucagccccggcaccagcggcagccccaucguggacagaaagggcaagguggugggccuguacggcaacggcguggugaccagaagcggcgccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacagaguggccgccgagggcaucaacuacgccgacagaagauggugcuucgacggcgugaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagagacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcgugggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucgccacccaggagcccgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcgugaccgugaucgaccuggaccccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaaggacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccaucgaggccggcagaacccugagagugcugagccugguggagaacuggcugaacaacgacacccaguucugcaucaaggugcugaaccccuacaugcccagcgugaucgagaagauggagacccugcagagaaaguacggcggcgcccuggugagaaacccccugagcagaaacagcacccacgagauguacugggugagcaacgccaccggcaacaucgugagcagcgugaacaugaucagcagaaugcugaucaacagauucaccaugaagcacaagaaggccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacguggugcccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcagauucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacauggagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcguguucaagagcauccagagacugaccgugaccgaggagaucgccgugcagaacuggcuggccagagugggcagagagagacugagcagaauggccaucagcggcgacgacugcguggugaagccccuggacgacagauucgccagcgcccugaccgcccugaacgacaugggcaaggugagaaaggacauccagcagugggagcccagcagaggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugaaggagaccgccugccugggcaagagcuacgcccagauguggagccugauguacuuccacagaagagaccugagacuggccgccaacgccaucugcagcgccgugcccagccacugggugcccaccagcagaaccaccuggagcauccacgccaagcacgaguggaugaccaccgaggacaugcugaccguguggaacagaguguggauccaggagaaccccuggauggaggacaagacccccguggagagcugggaggaggugcccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 17504 - RNA, 9876 nt, Artificial Sequence
  derived and/or modified CDS sequence (opt4) from DENV-2__EU482788__SS-prME
accgccggcgugaucaucaugcugauccccaccgccauggccuuccaccugaccaccagaaacggcgagccccacaugaucgugggcagacaggagaagggcaagagccugcuguucaagaccgaggacggcgugaacaugugcacccugauggccaucgaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgcccagagaaucgagaccuggauccugagacaccccggcuucaccaucauggccgccauccuggccuacaccgugggcaccacccacuuccagagagcccugaucuucauccugcuggccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaacgaggagcaggacaagagauucgugugcaagcacagcaugguggacagaggcuggggcaacggcugcggccuguucggcaagggcggcaucgugaccugcgccauguucaccugcaagaagaacauggagggcaagaucgugcagcccgagaaccuggaguacaccaucgugaucaccccccacagcggcgaggagcacgccgugggcaacgacaccggcaagcacggcaaggagaucaagaucaccccccagagccccaucaccgaggccgagcugaccggcuacggcaccgugaccauggagugcagccccagaaccggccuggacuucaacgagauggugcugcugcagauggaggacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagaucgugaaggagaucgccgagacccagcacggcaccaucgugaucagagugcaguacgagggcgacggcagccccugcaagauccccuucgagaucauggaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcgugaucacccuguaccugggcgccauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucaccaccaacaucuggcugaagcugagagagaagcaggacguguucugcgacagcaagcugaugagcgccgccaucaaggacaacagagccgugcacgccgacaugggcuacuggaucgagagcgcccugaacgacaccuggaagauggagaaggccagcuucaucgaggugaagagcugccacuggcccaagagccacacccuguggagcaacggcgugcuggagagcgagaugaucauccccaagagcuucgccggccccgugagccagcacaacuacagacccggcuacuacacccagaccgccggccccuggcaccugggcaagcuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcuggugaccgugagcuucgugacccugaucaccggcaacaugagcuucagagaccugggcagagugauggugauggugggcgccgccaugaccgacgacaucggcaugggcgugaccuaccuggcccugcuggccgccuucaaggugagacccaccuucgccgccggccugcugcugagaaagcugaccagcaaggagcugaugauggccaccaucggcaucgcccugcugagccagagcaccauccccgagaccauccuggagcugaccgacgcccuggcccugggcaugauggugcugaagaucgugagaaacauggagaaguaccagcuggccgugaccaucauggccaucagcugcgugcccaacgccgugauccugcagaacgccuggaaggugagcugcaccauccuggccgccgugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccaccgacgugaagugggaggaccaggccgagaucagcggcagcagccccauccugagcaucaccaucgccgaggacggcagcaugagcaucaagaacgaggaggaggagcagacccugaccauccugaucagaaccggccugcuggugaucagcggccuguuccccgugagcauccccaucaccgccgccgccugguaccugugggaggugaagaagcagagagccggcgugcugugggacgugcccagccccccccccgugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacagaggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucguggacagaaagggcaagguggugggccuguacggcaacggcguggugaccagaagcggcgccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacagaguggccgccgagggcaucaacuacgccgacagaagauggugcuucgacggcgugaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagaaacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcgugggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucgccacccaggagcccgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggaccccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaaggacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccaucgaggccggcagaacccugagagugcugagccugguggagaacuggcugaacaacgacacccaguucugcaucaaggugcugaaccccuacaugcccagcgugaucgagaagauggagacccugcagagaaaguacggcggcgcccuggugagaaacccccugagcagaaacagcacccacgagauguacugggugagcaacgccaccggcaacaucgugagcagcgugaacaugaucagcagaaugcugaucaacagauucaccaugaagcacaagaaggccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacguggugcccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcagauucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacauggagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcguguucaagagcauccagagacugaccgugaccgaggagaucgccgugcagaacuggcuggccagagugggcagagagagacugagcagaauggccaucagcggcgacgacugcguggugaagccccuggacgacagauucgccagcgcccugaccgcccugaacgacaugggcaaggugagaaaggacauccagcagugggagcccagcagaggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugaaggagaccgccugccugggcaagagcuacgcccagauguggagccugauguacuuccacagaagagaccugagacuggccgccaacgccaucugcagcgccgugcccagccacugggugcccaccagcagaaccaccuggagcauccacgccaagcacgaguggaugaccaccgaggacaugcugaccguguggaacagaguguggauccaggagaaccccuggauggaggacaagacccccguggagagcugggaggaggugcccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 17505 - RNA, 9876 nt, Artificial Sequence
  derived and/or modified CDS sequence (opt4) from DENV-2__EU482697__SS-prME
agcgccggcaugaucaucaugcugauccccaccgugauggccuuccaccugaccaccagaaacggcgagccccacaugaucgugggcauccaggagaagggcaagagccugcuguucaagaccgaggacggcgugaacaugugcacccugauggccauggaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgcccagagaaucgagaccuggauccugagacaccccggcuucaccaucauggccgccauccuggccuacaccaucggcaccacccacuuccagagagugcugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaaggaggagcaggacaagagauucgugugcaagcacagcaugguggacagaggcuggggcaacggcugcggccuguucggcaagggcggcaucgugaccugcgccauguucaccugcaagaagaacauggagggcaagaucgugcagcccgagaaccuggaguacaccaucguggugaccccccacagcggcgaggagcacgccgugggcaacgacaccggcaagcacggccaggagaucaaggugaccccccagagcagcaucaccgaggccgagcugaccggcuacggcaccgugaccauggagugcagccccagaaccggccuggacuucaacgagauggugcugcugcagauggagaacaaggccuggcuggugcacagacagugguuccuggaccugccccugcccuggcugcccggcgccgacaagcaggagagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucgugaucagagugcaguacgagggcgacggcagccccugcaagauccccuucgagaucauggaccuggagaagagauacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcaucgugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccaggaggagggcaucugcggcaucagaagcgugaccagacuggagaaccugauguggaagcagaucacccccgagcugaaccacauccuggccgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagcuacaaccagaccuuccugaucgacggccccgagaccgccgagugccccaacaccaacagagccuggaacagccuggagguggaggacuacggcuucggcguguucaccaccaacaucuggcugaagcugaaggagaagcaggacgccuucugcgacagcaagcugaugagcgccgccaucaaggacaacagagccgugcacgccgacaugggcuacuggaucgagagcgcccugaacgacaccuggaagaucgagaaggccagcuucaucgaggugaagaacugccacuggcccaagagccacacccuguggagcaacggcgugcuggagagcgagaugaucauccccaagaaccuggccggccccgugagccagcacaacuacagacccggcuaccacacccagaucgccggccccuggcaccugggcaagcuggagauggacuucgacuucugcgacggcaccaccgugaucgugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagguggacaacuucagccugggcgugcugggcauggcccuguuccuggaggagaugcugagaaccagagugggcaccaagcacgccauccugcugguggccgugagcuucgugacccugaucaccggcaacaugagcuucaaggaccugggcagagugguggugauggugggcgccaccaugaccgacgacaucggcaugggcgugaccuaccuggcccugcuggccgccuucaaggugagacccaccuucgccgccggccugcugcugagaaagcugaccagcaaggagcugaugaugaccaccaucggcaucgugcugcugagccagagcaccauccccgagaccgugcuggagcugaccgacgcccuggcccugggcaugauggugcugaagaucgugagaaacauggagaaguaccagcuggccgugaccaucauggccauccugugcgugcccaacgccgugauccugcagaacgccuggaaggugagcugcaccauccuggccguggugagcgugagcccccugcugcugaccagcagccagcagaagaccgacuggaucccccuggcccugaccaucaagggccugaaccccaccgccaucuuccugaccacccugagcagaaccaacaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccaccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggccuguuccccaucagcauccccaucaccgccgccgccugguaccugugggaggugaagaagcagagagccggcgugcugugggacgugcccagccccccccccaugggcaaggccgagcuggaggacggcgccuacagaaucaagcagaagggcauccugggcuacagccagaucggcgccggcguguacagagagggcaccuuccacaccauguggcacgugaccagaggcgccgugcugaugcacaagggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucaucgacaagaagggcaagguggugggccuguacggcaacggcguggugaccagaagcggcgccuacgugagcgccaucgcccagaccgagaagagcaucgaggacaaccccgagaucgaggacgacaucuucagaaagagaagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucaucgacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaagauggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaagaccagagacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcagaggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucgccacccagcagcccgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggaccccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaugggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaucccccccgagaagugcgacacccugcugugcgacaucggcgagagcagccccaaccccaccguggaggccggcagaacccugagagugcugaaccugguggagaacuggcugaacaacaacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccagcggcaacaucgugagcagcgugaacaugaucagcagaaugcugaucaacagauucaccaugagacacaagaaggccaccuacgagcccgacguggaccugggcagcggcaccagaaacaucggcaccgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacgugcugcccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcagauucugggagcugguggacaaggagagaaacuuccaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacauggagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcguguucaagaacauccagcaccugaccgugaccgaggagguggccgugaagaacuggcuggccagagugggcagagagagacugagcagaauggccaucagcggcgacgacugcguggugaagccccuggacgacagauucgccaacgcccugaccgcccugaacgacaugggcaagaucagaaaggacauccagcagugggagcccagcaagggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugagagagaccgccugccugggcaagagcuacgcccagauguggagccugauguacuuccacagaagagaccugagacuggccgccaacgccaucugcagcgccgugcccagccacugggugcccaccagcagaaccaccuggagcauccacgccaagcacgaguggaugaccaccgaggacaugcugaccguguggaacagaguguggaucagagagaaccccuggauggaggacaagacccccguggagagcugggaggagauccccuaccugggcaagagagaggaccaguggugcggcagccugaucggccugaccagcagagccaccugggccaagaacauccaggccgccaucaaccaggugagaagccugaucggcaacgaggaguacaccgacuacaugcccagcaugaagagauucagaagagaggaggaggaggccggcgugcugugguga

SEQ ID NO: 17506 - RNA, 9876 nt, Artificial Sequence
  derived and/or modified CDS sequence (opt4) from DENV-2__EU482699__SS-prME
agcgccggcaugaucaucaugcugauccccaccgugauggccuuccaccugaccaccagaaacggcgagccccacaugaucgugggcauccaggagaagggcaagagccugcuguucaagaccgaggacggcgugaacaugugcacccugauggccauggaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgcccagagaaucgagaccuggauccugagacaccccggcuucaccaucauggccgccauccuggccuacaccaucggcaccacccacuuccagagagugcugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaaggaggagcaggacaagagauucgugugcaagcacagcaugguggacagaggcuggggcaacggcugcggccuguucggcaagggcggcaucgugaccugcgccauguucaccugcaagaagaacauggagggcaagaucgugcagcccgagaaccuggaguacaccaucguggugaccccccacagcggcgaggagcacgccgugggcaacgacaccggcaagcacggcaaggagaucaaggugaccccccagagcagcaucaccgaggccgagcugaccggcuacggcaccgugaccauggagugcagccccagaaccggccuggacuucaacgagauggugcugcugcagauggagaacaaggccuggcuggugcacagacagugguuccuggaccugccccugcccuggcugcccggcgccgacaagcaggagagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucgugaucagagugcaguacgagggcgacggcagccccugcaagauccccuucgagaucauggaccuggagaagagauacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcaucgugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccaggaggagggcaucugcggcaucagaagcgugaccagacuggagaaccugauguggaagcagaucacccccgagcugaaccacauccuggccgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucaccaccaacaucuggcugagacugaaggagaagcaggacgccuucugcgacagcaagcugaugagcgccgccaucaaggacaacagagccgugcacgccgacaugggcuacuggaucgagagcgcccugaacgacaccuggaagaucgagaaggccagcuucaucgaggugaagaacugccacuggcccaagagccacacccuguggagcaacggcgugcuggagagcgagaugaucauccccaagaaccuggccggccccgugagccagcacaacuacagacccggcuaccacacccagaucgccggccccuggcaccugggcaagcuggagauggacuucgacuucugcgacggcaccaccgugaucgugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagguggacaacuucagccugggcauccugggcauggcccuguuccuggaggagaugcugagaaccagagugggcaccaagcacgccauccugcuggccgccgugagcuucgugacccugaucaccggcaacaugagcuucaaggaccugggcagagugauggugauggugggcgccaccauggccgacgacaucggcaugggcgugaccuaccuggcccugcuggccgccuucaaggugagacccaccuucgccgccggccugcugcugagaagacugaccagcaaggagcugaugaugaccaccaucggcaucgugcugcugagccagagcaccauccccgagaccgugcuggagcugaccgacgcccuggcccugggcaugauggugcugaagaucgugagaaagauggagaaguaccagcuggccgugaccaucauggccauccugugcgugcccaacgccgugauccugcagaacgccuggaaggugagcugcaccauccuggccguggugagcgugagcccccugcugcugaccagcagccagcagaagaccgacuggaucccccuggcccugaccaucaagggccugaaccccaccgccaucuuccugaccacccugagcagaaccaacaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccaccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggccuguuccccaucagcauccccaucaccgccgccgccugguaccugugggaggugaagaagcagagagccggcgugcugugggacgugcccagccccccccccgugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacaagggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucaucgacaagaagggcaagguggugggccuguacggcaacggcguggugaccagaagcggcgccuacgugagcgccaucgcccagaccgagaagagcaucgaggacaaccccgagaucgaggacgacaucuucagaaagagaagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucaucgacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaagauggugcuucgacggcaucaagaacaaccagauccuggaggagaacguggagguggagaucuggaccaagggcggcgagaagaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaagaccagagacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcagaggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucgccacccagcagcccgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggaccccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaugggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaucccccccgagaagugcgacacccugcugugcgacaucggcgagagcagccccaaccccaccguggaggccggcagaacccugagagugcugaaccugguggagaacuggcugaacaacaacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccagcggcaacaucgugagcagcgugaacaugaucagcagaaugcugaucaacagauucaccaugagacacaagaaggccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacgugcugcccaccgugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcagauucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacauggagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcguguucaagaacauccagcaccugaccgugaccgaggagguggccgugcagaacuggcuggccagagugggcagagagagacugagcagaauggccaucagcggcgacgacugcguggugaagccccuggacgacagauucgccaacgcccugaccgcccugaacgacaugggcaagaucagaaaggacauccagcagugggagcccagcaagggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugagagagaccgccugccugggcaagagcuacgcccagauguggagccugauguacuuccacagaagagaccugagacuggccgccaacgccaucugcagcgccgugcccagccacugggugcccaccagcagaaccaccuggagcauccacgccaagcacgaguggaugaccaccgaggacaugcugaccguguggaacagaguguggaucagagagaaccccuggauggaggacaagacccccguggagagcugggaggagauccccuaccugggcaagagagaggaccaguggugcggcagccugaucggccugaccagcagagccaccugggccaagaacauccaggccgccaucaaccaggugagaagccugaucggcaacgaggaguacaccgacuacaugcccagcaugaagagauucagaagagaggaggaggaggccggcgugcugugguga

SEQ ID NO: 17507 - RNA, 9876 nt, Artificial Sequence
  derived and/or modified CDS sequence (opt4) from DENV-2__EU482701__SS-prME
agcgccggcaugaucaucaugcugauccccaccgugauggccuuccaccugaccaccagaaacggcgagccccacaugaucgugggcauccaggagaagggcaagagccugcuguucaagaccgaggacggcgugaacaugugcacccugauggccauggaccugggcgagcugugcgaggacaccaucaccuacaagugcccccugcugaagcagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgcccagagaaucgagaccuggauccugagacaccccggcuucaccaucauggccgccauccuggccuacaccaucggcaccacccacuuccagagagugcugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaaggaggagcaggacaagagauucgugugcaagcacagcaugguggacagaggcuggggcaacggcugcggccuguucggcaagggcggcaucgugaccugcgccauguucaccugcaagaagaacauggagggcaagaucgugcagcccgagaaccuggaguacaccaucguggugaccccccacagcggcgaggagcacgccgugggcaacgacaccggcaagcacggcaaggagaucaaggugaccccccagagcagcaucaccgaggccgagcugaccggcuacggcaccgugaccauggagugcagccccagaaccggccuggacuucaacgagauggugcugcugcagauggagaacaaggccuggcuggugcacagacagugguuccuggaccugccccugcccuggcugcccggcgccgacaagcaggagagcaacuggauccagaaggagacccuggugaccuucaagaacccccacgccaagaagcaggacgugguggugcugggcagccaggagggcgccaugcacgccgcccugaccggcgccaccgagauccagaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucgugaucagagugcaguacgagggcgacggcagccccugcaagauccccuucgagaucauggaccuggagaagagauacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcaucgugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccaggaggagggcaucugcggcaucagaagcgugaccagacuggagaaccugauguggaagcagaucacccccgagcugaaccacauccuggccgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucaccaccaacaucuggcugagacugaaggagaagcaggacgccuucugcgacagcaagcugaugagcgccgccgugaaggacaacagagccgugcacgccgacaugggcuacuggaucgagagcgcccugaacgacaccuggaagaucgagaaggccagcuucaucgaggugaagaacugccacuggcccaagagccacacccuguggagcaacggcgugcuggagagcgagauggugauccccaagaaccuggccggccccgugagccagcacaacuacagacccggcuaccacacccagaucgccggccccuggcaccugggcaagcuggagauggacuucgacuucugcgacggcaccaccgugaucgugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagguggacaacuucagccugggcauccugggcauggcccuguuccuggaggagaugcugagaaccagagugggcaccaagcacgccauccugcugguggccgugagcuucgugacccugaucaccggcaacaugagcuucaaggaccugggcagagugguggugauggugggcgccaccauggccgacgacaucggcaugggcgugaccuaccuggcccugcuggccgccuucaaggugagacccaccuucgccgccggccugcugcugagaaagcugaccagcaaggagcugaugaugaccaccaucggcguggugcugcugagccagagcaccauccccgacaccgugcuggagcugaccgacgcccuggcccugggcaugauggugcugaagaucgugagaaacauggagaaguaccagcuggccgugaccaucauggccauccugugcgugcccaacgccgugauccugcagaacgccuggaaggugagcugcaccauccuggccguggugagcgugagcccccugcugcugaccagcagccagcagaagaccgacuggaucccccuggcccugaccaucaagggccugaaccccaccgccaucuuccugaccacccugagcagaaccaacaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccaccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggccuguuccccaucagcauccccaucaccgccgccgccugguaccugugggaggugaagaagcagagagccggcgugcugugggacgugcccagccccccccccaugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacaagggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucaucgacaagaagggcaagguggugggccuguacggcaacggcguggugaccagaagcggcgccuacgugagcgccaucgcccagaccgagaagagcaucgaggacaaccccgagaucgaggacgacaucuucagaaagagaagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucaucgacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaagauggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaagaccagagacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcagaggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucgccacccagcagcccgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggaccccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaugggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaucccccccgagaagugcgacacccugcugugcgacaucggcgagagcagccccaaccccaccguggaggccggcagaacccugagagugcugaaccugguggagaacuggcugaacaacaacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccagcggcaacaucgugagcagcgugaacaugaucagcagaaugcugaucaacagauucaccaugagacacaagaaggccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacgugcugcccaccgugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcagauucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacauggagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcguguucaagaacauccagcaccugaccgugaccgaggagguggccgugcagaacuggcuggccagagugggcagagagagacugagcagaauggccaucagcggcgacgacugcguggugaagccccuggacgacagauucgccaacgcccugaccgcccugaacgacaugggcaagaucagaaaggacauccagcagugggagcccagcaagggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugagagagaccgccugccugggcaagagcuacgcccagauguggagccugauguacuuccacagaagagaccugagacuggccgccaacgccaucugcagcgccgugcccagccacugggugcccaccagcagaaccaccuggagcauccacgccaagcacgaguggaugaccaccgaggacaugcugaccguguggaacagaguguggaucagagagaaccccuggauggaggacaagacccccguggagagcugggaggagauccccuaccugggcaagagagaggaccaguggugcggcagccugaucggccugaccagcagagccaccugggccaagaacauccaggccgccaucaaccaggugagaagccugaucggcaacgaggaguacaccgacuacaugcccagcaugaagagauucagaagagaggaggaggaggccggcgugcugugguga

SEQ ID NO: 17508 - RNA, 9876 nt, Artificial Sequence
  derived and/or modified CDS sequence (opt4) from DENV-2__EU482703__SS-prME
agcgccggcaugaucaucaugcugauccccaccgugauggccuuccaccugaccaccagaaacggcgagccccacaugaucgugggcauccaggagaagggcaagagccugcuguucaagaccgaggacggcgugaacaugugcacccugauggccauggaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgcccagagaaucgagaccuggauccugagacaccccggcuucaccaucauggccgccauccuggccuacaccaucggcaccacccacuuccagagagugcugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaaggaggagcaggacaagagauucgugugcaagcacagcaugguggacagaggcuggggcaacggcugcggccuguucggcaagggcggcaucgugaccugcgccauguucaccugcaagaagaacauggagggcaagaucgugcagcccgagaaccuggaguacaccaucguggugaccccccacagcggcgaggagcacgccgugggcaacgacaccggcaagcacggcaaggagaucaaggugaccccccagagcagcaucaccgaggccgagcugaccggcuacggcaccgugaccauggagugcagccccagaaccggccuggacuucaacgagauggugcugcugcagauggagaacaaggccuggcuggugcacagacagugguuccuggaccugccccugcccuggcugcccggcgccgacaagcaggagagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucgugaucagagugcaguacgagggcgacggcagccccugcaagauccccuucgagaucauggaccuggagaagagauacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcaucgugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccaggaggagggcaucugcggcaucagaagcgugaccagacuggagaaccugauguggaagcagaucacccccgagcugaaccacauccuggccgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagcuacaaccagaccuuccugaucgacggccccgagaccgccgagugccccaacaccaacagagccuggaacagccuggagguggaggacuacggcuucggcguguucaccaccaacaucuggcugaagcugaaggagaagcaggacgccuucugcgacagcaagcugaugagcgccgccaucaaggacaacagagccgugcacgccgacaugggcuacuggaucgagagcgcccugaacgacaccuggaagaucgagaaggccagcuucaucgaggugaagaacugccacuggcccaagagccacacccuguggagcaacggcgugcuggagagcgagaugaucauccccaagaaccuggccggccccgugagccagcacaacuacagacccggcuaccacacccagaucgccggccccuggcaccugggcaagcuggagauggacuucgacuucugcgacggcaccaccgugaucgugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagguggacaacuucagccugggcgugcugggcauggcccuguuccuggaggagaugcugagaaccagagugggcaccaagcacgccauccugcugguggccgugagcuucgugacccugaucaccggcaacaugagcuucaaggaccugggcagagugguggugauggugggcgccaccauggccgacgacaucggcaugggcgugaccuaccuggcccugcuggccgccuucaaggugagacccaccuucgccgccggccugcugcugagaaagcugaccagcaaggagcugaugaugaccaccaucggcaucgugcugcugagccagagcaccauccccgagaccgugcuggagcugaccgacgcccuggcccugggcaugauggugcugaagaucgugagaaacauggagaaguaccagcuggccgugaccaucauggccauccugugcgugcccaacgccgugauccugcagaacgccuggaaggugggcugcaccauccuggccguggugagcgugagcccccugcugcugaccagcagccagcagaagaccgacuggaucccccuggcccugaccaucaagggccugaaccccaccgccaucuuccugaccacccugagcagaaccaacaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccaccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggccuguuccccaucagcauccccaucaccgccgccgccugguaccugugggaggugaagaagcagagagccggcgugcugugggacgugcccagccccccccccaugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacaagggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucaucgacaagaagggcaagguggugggccuguacggcaacggcguggugaccagaagcggcgccuacgugagcgccaucgcccagaccgagaagagcaucgaggacaaccccgagaucgaggacgacaucuucagaaagagaagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucaucgacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaagauggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaagaccagagacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcagaggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucgccacccagcagcccgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggaccccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaugggcgagacccugggcgagaaguggaagagcagacugaacgcccugggcaagagcgaguuccagaucuacaagagaagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaucccccccgagaagugcgacacccugcugugcgacaucggcgagagcagccccaaccccaccguggaggccggcagaacccugagagugcugaaccugguggagaacuggcugaacaacaacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccagcggcaacaucgugagcagcgugaacaugaucagcagaaugcugaucaacagauucaccaugagacacaagaaggccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacgugcugcccaccgugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccaagaaggugagaagcaacgccgcccugggcgccaucuucaccgacgagaacaaguggaagagcgccagagaggccguggaggacagcagauucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacaugaagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcguguucaagaacauccagcaccugaccgugaccgaggagguggccgugcagaacuggcuggccagagugggcagagagagacugagcagaauggccaucagcggcgacgacugcguggugaagccccuggacgacagauucgccaacgcccugaccgcccugaacgacaugggcaagaucagaaaggacauccagcagugggagcccagcaagggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugagagagaccgccugccugggcaagagcuacgcccagauguggagccugauguacuuccacagaagagaccugagacuggccgccaacgccaucugcagcgccgugcccagccacugggugcccaccagcagaaccaccuggagcauccacgccaagcacgaguggaugaccaccgaggacaugcugaccguguggaacagaguguggaucagagagaaccccuggauggaggacaagacccccguggagagcugggaggagauccccuaccugggcaagagagaggaccaguggugcggcagccugaucggccugaccagcagagccaccugggccaagaacauccaggccgccaucaaccaggugagaagccugaucggcaacgaggaguacaccgacuacaugcccagcaugaagagauucagaagagaggaggaggaggccggcgugcugugguga

SEQ ID NO: 17509 - RNA, 9876 nt, Artificial Sequence
  derived and/or modified CDS sequence (opt4) from DENV-2__EU482705__SS-prME
agcgccggcaugaucaucaugcugauccccaccgugauggccuuccaccugaccaccagaaacggcgagccccacaugaucgugggcauccaggagaagggcaagagccugcuguucaagaccgaggacggcgugaacaugugcacccugauggccauggaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgcccagagaaucgagaccuggauccugagacaccccggcuucaccaucauggccgccauccuggccuacaccaucggcaccacccacuuccagagagugcugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaaggaggagcaggacaagagauucgugugcaagcacagcaugguggacagaggcuggggcaacggcugcggccuguucggcaagggcggcaucgugaccugcgccauguucaccugcaagaagaacauggagggcaagaucgugcagcccgagaaccuggaguacaccaucguggugaccccccacagcggcgaggagcacgccgugggcaacgacaccggcaagcacggcaaggagaucaaggugaccccccagagcagcaucaccgaggccgagcugaccggcuacggcaccgugaccauggagugcagccccagaaccggccuggacuucaacgagauggugcugcugcagauggagaacaaggccuggcuggugcacagacagugguuccuggaccugccccugcccuggcugcccggcgccgacaagcaggagagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucgugaucagagugcaguacgagggcgacggcagccccugcaagauccccuucgagaucauggaccuggagaagagauacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcaucgugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccaggaggagggcaucugcggcaucagaagcgugaccagacuggagaaccugauguggaagcagaucacccccgagcugaaccacauccuggccgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagcuacaaccagaccuuccugaucgacggccccgagaccaccgagugccccaacaccaacagagccuggaacagccuggagguggaggacuacggcuucggcguguucaccaccaacaucuggcugaagcugaaggagaagcaggacgccuucugcgacagcaagcugaugagcgccgccaucaaggacaacagagccgugcacgccgacaugggcuacuggaucgagagcgcccugaacgacaccuggaagaucgagaaggccagcuucaucgaggugaagaacugccacuggcccaagagccacacccuguggagcaacggcgugcuggagagcgagaugaucauccccaagaaccuggccggccccgugagccagcacaacuacagacccggcuaccacacccagaucgccggccccuggcaccugggcaagcuggagauggacuucgacuucugcgacggcaccaccgugaucgugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagguggacaacuucagccugggcgugcugggcauggcccuguuccuggaggagaugcugagaaccagagugggcaccaagcacgccauccugcugguggccgugagcuucgugacccugaucaccggcaacaugagcuucaaggaccugggcagagugguggugauggugggcgccaccauggccgacaacaucggcaugggcgugaccuaccuggcccugcuggccgccuucaaggugagacccaccuucgccgccggccugcugcugagaagacugaccagcaaggagcugaugaugaccaccaucggcaucgugcugcugagccagagcaccauccccgagaccgugcuggagcugaccgacgcccuggcccugggcaugauggugcugaagaucgugagaaacauggagaaguaccagcuggccgugaccaucauggccauccugugcgugcccaacgccgugauccugcagaacgccuggaaggugagcugcaccauccuggccguggugagcgugagcccccugcugcugaccagcagccagcagaagaccgacuggaucccccuggcccugaccaucaagggccugaaccccaccgccaucuuccugaccacccugagcagaaccaacaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccaccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggccuguuccccaucagcauccccaucaccgccgccgccugguaccugugggaggugaagaagcagagagccggcgugcugugggacgugcccagccccccccccaugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacaagggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucaucgacaagaagggcaagguggugggccuguacggcaacggcguggugaccagaagcggcgccuacgugagcgccaucgcccagaccgagaagagcaucgaggacaaccccgagaucgaggacgacaucuucagaaagagaagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucaucgacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaagauggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaagaccagagacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcagaggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucgccacccagcagcccgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggaccccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaucccccccgagaagugcgacacccugcugugcgacaucggcgagagcagccccaaccccaccguggaggccggcagaacccugagagugcugaaccugguggagaacuggcugaacaacaacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccagcggcaacaucgugagcagcgugaacaugaucagcagaaugcugaucaacagauucaccaugagacacaagaaggccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacgugcugcccaccgugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcagauucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacauggagggcgagcacaagagacuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcguguucaagaacauccagcaccugaccgugaccgaggagguggccgugcagaacuggcuggccagagugggcagagagagacugagcagaauggccaucagcggcgacgacugcguggugaagccccuggacgacagauucgccaacgcccugaccgcccugaacgacaugggcaagaucagaaaggacauccagcagugggagcccagcaagggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugagagagaccgccugccugggcaagagcuacgcccagauguggagccugauguacuuccacagaagagaccugagacuggccgccaacgccaucugcagcgccgugcccagccacugggugcccaccagcagaaccaccuggagcauccacgccaagcacgaguggaugaccaccgaggacaugcugaccguguggaacagaguguggaucagagagaaccccuggauggaggacaagacccccguggagagcugggaggagauccccuaccugggcaagagagaggaccaguggugcggcagccugaucggccugaccagcagagccaccugggccaagaacauccaggccgccaucaaccaggugagaagccugaucggcaacgaggaguacaccgacuacaugcccagcaugaagagauucagaagagaggaggaggaggccggcgugcugugguga

SEQ ID NO: 17510 - RNA, 9876 nt, Artificial Sequence
  derived and/or modified CDS sequence (opt4) from DENV-2__EU482463__SS-prME
agcgccggcaugaucaucaugcugauccccaccgugauggccuuccaccugaccaccagaaacggcgagccccacaugaucgugagcauccaggagaagggcaagagccugcuguucaagaccgaggacggcgugaacaugugcacccugauggccauggaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgcccagagaaucgagaccuggauccugagacaccccggcuucaccaucauggccgccauccuggccuacaccaucggcaccacccacuuccagagagugcugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaaggaggagcaggacaagagauucgugugcaagcacagcaugguggacagaggcuggggcaacggcugcggccuguucggcaagggcggcaucgugaccugcgccauguucaccugcaagaagaacauggagggcaagaucgugcagcccgagaaccuggaguacaccaucguggugaccccccacagcggcgaggagcacgccgugggcaacgacaccggcaagcacggcaaggagaucaaggugaccccccagagcagcaucaccgaggccgagcugaccggcuacggcaccgugaccauggagugcagccccagaaccggccuggacuucaacgagauggugcugcugcagauggagaacaaggccuggcuggugcacagacagugguuccuggaccugccccugcccuggcugcccggcgccgacaagcaggagagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucgugaucagagugcaguacgagggcgacggcagccccugcaagauccccuucgagaucauggaccuggagaagagauacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcaucgugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccaggaggagggcaucugcggcaucagaagcgugaccagacuggagaaccugauguggaagcagaucacccccgagcugaaccacauccuggccgagaacgaggugaagcugaccaucaugaccggcgacaucagaggcaucaugcaggccggcaagagaagccugagaccccagcccaccgagcugaaguacagcuggaagaccuggggcaaggccaagaugcugagcaccgagagcuacaaccagaccuuccugaucgacggccccgagaccgccgagugccccaacaccaacagagccuggaacagccuggagguggaggacuacggcuucggcguguucaccaccaacaucuggcugaagcugaaggagaagcaggacgccuucugcgacagcaagcugaugagcgccgccaucaaggacaacagagccgugcacgccgacaugggcuacuggaucgagagcgcccugaacgacaccuggaagaucgagaaggccagcuucaucgaggugaagaacugccacuggcccaagagccacacccuguggagcaacggcgugcuggagagcgagaugaucauccccaagaaccuggccggccccgugagccagcacaacuacagacccggcuaccacacccagaucgccggccccuggcaccugggcaagcuggagauggacuucgacuucugcgacggcaccaccgugaucgugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagguggacaacuucagccugggcgugcugggcauggcccuguuccuggaggagaugcugagaaccagagugggcaccaagcacgccauccugcugguggccgugagcuucgugacccugaucaccggcaacaugagcuucaaggaccugggcagagugguggugauggugggcgccaccauggccgacgacaucggcaugggcgugaccuaccuggcccugcuggccgccuucaaggugagacccaccuucgccgccggccugcugcugagaaagcugaccagcaaggagcugaugaugaccaccaucggcaucgugcugcugagccagagcaccauccccgagaccgugcuggagcugaccgacgcccuggcccugggcaugauggugcugaagaucgugagaaacauggagaaguaccagcuggccgugaccaucauggccauccugugcgugcccaacgccgugauccugcagaacgccuggaaggugagcugcaccauccuggccguggugagcgugagcccccugcugcugaccagcagccagcagaagaccgacuggaucccccuggcccugaccaucaagggccugaaccccaccgccaucuuccugaccacccugagcagaaccaacaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccaccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggccuguuccccaucagcauccccaucaccgccgccgccugguaccugugggaggugaagaagcagagagccggcgugcugugggacgugcccagccccccccccaugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacaagggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucaucgacaagaagggcaagguggugggccuguacggcaacggcguggugaccagaagcggcgccuacgugagcgccaucgcccagaccgagaagagcaucgaggacaaccccgagaucgaggacgacaucuucagaaagagaagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucaucgacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaagauggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaagaccagagacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcagaggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucgccacccagcagcccgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggaccccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaucccccccgagaagugcgacacccugcugugcgacaucggcgagagcagccccaaccccaccguggaggccggcagaacccugagagugcugaaccugguggagaacuggcugaacaacaacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccagcggcaacaucgugagcagcgugaacaugaucagcagaaugcugaucaacagauucaccaugagacacaagaaggccaccuacgagcccgacguggaccugggcagcggcaccagaaacaucggcaucgagagcgagaagcccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacgugcugcccaccgugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcagauucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacauggagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcguguucaagaacauccagcaccugaccgugaccgaggagguggccgugcacaacuggcuggccagagugggcagagagagacugagcagaauggccaucagcggcgacgacugcguggugaagccccuggacgacagauucgccaacgcccugaccgcccugaacgacaugggcaagaucagaaaggacauccagcagugggagcccagcaagggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugagagagaccgccugccugggcaagagcuacgcccagauguggagccugauguacuuccacagaagagaccugagacuggccgccaacgccaucugcagcgccgugcccagccacugggugcccaccagcagaaccaccuggagcauccacgccaagcacgaguggaugaccaccgaggacaugcugaccguguggaacagaguguggaucagagagaaccccuggauggaggacaagacccccguggagagcugggaggagauccccuaccugggcaagagagaggaccaguggugcggcagccugaucggccugaccagcagagccaccugggccaagaacauccaggccgccaucaaccaggugagaagccugaucggcaacgaggaguacaccgacuacaugcccagcaugaagagauucagaagagaggaggaggaggccggcgugcugugguga

SEQ ID NO: 17511 - RNA, 9876 nt, Artificial Sequence
  derived and/or modified CDS sequence (opt4) from DENV-2__EU482464__SS-prME
agcgccggcaugaucaucaugcugauccccaccgugauggccuuccaccugaccaccagaaacggcgagccccacaugaucgugggcauccaggagaagggcaagagccugcuguucaagaccgaggacggcgugaacaugugcacccugauggccauggaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgcccagagaaucgagaccuggauccugagacaccccggcuucaccaucauggccgccauccuggccuacaccaucggcaccacccacuuccagagagugcugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaaggaggagcaggacaagagauucgugugcaagcacagcaugguggacagaggcuggggcaacggcugcggccuguucggcaagggcggcaucgugaccugcgccauguucaccugcaagaagaacauggagggcaagaucgugcagcccgagaaccuggaguacaccaucguggugaccccccacagcggcgaggagcacgccgugggcaacgacaccggcaagcacggcaaggagaucaaggugaccccccagagcagcaucaccgaggccgagcugaccggcuacggcaccgugaccauggagugcagccccagaaccggccuggacuucaacgagauggugcugcugcagauggagaacaaggccuggcuggugcacagacagugguuccuggaccugccccugcccuggcugcccggcgccgacaagcaggagagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucgugaucagagugcaguacgagggcgacggcagccccugcaagauccccuucgagaucauggaccuggagaagagauacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcaucgugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccaggaggagggcaucugcggcaucagaagcgugaccagacuggagaaccugauguggaagcagaucacccccgagcugaaccacauccuggccgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagcuacaaccagaccuuccugaucgacggccccgagaccaccgagugccccaacaccaacagagccuggaacagccuggagguggaggacuacggcuucggcguguucaccaccaacaucuggcugaagcugaaggagaagcaggacgccuucugcgacagcaagcugaugagcgccgccaucaaggacaacagagccgugcacgccgacaugggcuacuggaucgagagcgcccugaacgacaccuggaagaucgagaaggccagcuucaucgaggugaagaacugccacuggcccaagagccacacccuguggagcaacggcgugcuggagagcgagaugaucauccccaagaaccuggccggccccgugagccagcacaacuacagacccggcuaccacacccagaucgccggccccuggcaccugggcaagcuggagauggacuucgacuucugcgacggcaccaccgugaucgugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagguggacaacuucagccugggcgugcugggcauggcccuguuccuggaggagaugcugagaaccagagugggcaccaagcacgccauccugcugguggccgugagcuucgugacccugaucaccggcaacaugagcuucaaggaccugggcagagugguggugauggugggcaccaccauggccgacgacaucggcaugggcgugaccuaccuggcccugcuggccgccuucaaggugagacccaccuucgccgccggccugcugcugagaaagcugaccagcaaggagcugaugaugaccaccaucggcaucgugcugcugagccagagcaccauccccgagaccgugcuggagcugaccgacgcccuggcccugggcaugauggugcugaagaucgugagaaacauggagaaguaccagcuggccgugaccaucauggccauccugugcgugcccaacgccgugauccugcagaacgccuggaaggugagcugcaccauccuggccguggugagcgugagcccccugcugcugaccagcagccagcagaagaccgacuggaucccccuggcccugaccaucaagggccugaaccccaccgccaucuuccugaccacccugagcagaaccaacaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccaccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggccuguuccccaucagcauccccaucaccgccgccgccugguaccugugggaggugaagaagcagagagccggcgugcugugggacgugcccagccccccccccaugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacaagggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucaucgacaagaagggcaagguggugggccuguacggcaacggcguggugaccagaagcggcgccuacgugagcgccaucgcccagaccgagaagagcaucgaggacaaccccgagaucgaggacgacaucuucagaaagagaagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucaucgacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaagauggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaagaccagagacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcagaggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucgccacccagcagcccgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggaccccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaucccccccgagaagugcgacacccugcugugcgacaucggcgagagcagccccaaccccaccguggaggccggcagaacccugagagugcugaaccugguggagaacuggcugaacaacaacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccagcggcaacaucgugagcagcgugaacaugaucagcagaaugcugaucaacagauucaccaugagacacaagaaggccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacgugcugcccaccgugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcagauucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacauggagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcguguucaagaacauccagcaccugaccgugaccgaggagguggccgugcagaacuggcuggccagagugggcagagagagacugagcagaauggccaucagcggcgacgacugcguggugaagccccuggacgacagauucgccaacgcccuggccgcccugaacgacaugggcaagaucagaaaggacauccagcagugggagcccagcaagggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugagagagaccgccugccugggcaagagcuacgcccagauguggagccugauguacuuccacagaagagaccugagacuggccgccaacgccaucugcagcgccgugcccagccacugggugcccaccagcagaaccaccuggagcauccacgccaagcacgaguggaugaccaccgaggacaugcugaccguguggaacagaguguggaucagagagaaccccuggauggaggacaagacccccguggagagcugggaggagauccccuaccugggcaagagagaggaccaguggugcggcagccugaucggccugaccagcagagccaccugggccaagaacauccaggccgccaucaaccaggugagaagccugaucggcaacgaggaguacaccgacuacaugcccagcaugaagagauucagaagagaggaggaggaggccggcgugcugugguga

SEQ ID NO: 17512 - RNA, 9876 nt, Artificial Sequence
  derived and/or modified CDS sequence (opt4) from DENV-2__EU482465__SS-prME
agcgccggcaugaucaucaugcugauccccaccgugauggccuuccaccugaccaccagaaacggcgagccccacaugaucgugggcauccaggagaagggcaagagccugcuguucaagaccgaggacggcgugaacaugugcacccugauggccauggaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgcccagagaaucgagaccuggauccugagacaccccggcuucaccaucauggccgccauccuggccuacaccaucggcaccacccacuuccagagagugcugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaaggaggagcaggacaagagauucaucugcaagcacagcaugguggacagaggcuggggcaacggcugcggccuguucggcaagggcggcaucgugaccugcgccauguucaccugcaagaagaacauggagggcaagaucgugcagcccgagaaccuggaguacaccaucguggugaccccccacagcggcgaggagcacgccgugggcaacgacaccggcaagcacggcaaggagaucaaggugaccccccagagcagcaucaccgaggccgagcugaccggcuacggcaccgugaccauggagugcagccccagaaccggccuggacuucaacgagauggugcugcugcagauggagaacaaggccuggcuggugcacagacagugguuccuggaccugccccugcccuggcugcccggcgccgacaagcaggagagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucgugaucagagugcaguacgagggcgacggcagccccugcaagauccccuucgagaucauggaccuggagaagagauacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcaucgugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccaggaggagggcaucugcggcaucagaagcgugaccagacuggagaaccugauguggaagcagaucacccccgagcugaaccacauccuggccgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagcuacaaccagaccuuccugaucgacggccccgagaccgccgagugccccaacaccaacagagccuggaacagccuggagguggaggacuacggcuucggcguguucaccaccaacaucuggcugaagcugaaggagaagcaggacgccuucugcgacagcaagcugaugagcgccgccaucaaggacaacagagccgugcacgccgacaugggcuacuggaucgagagcgcccugaacgacaccuggaagaucgagaaggccagcuucaucgaggugaagaacugccacuggcccaagagccacacccuguggagcaacggcgugcuggagagcgagaugaucauccccaagaaccuggccggccccgugagccagcacaacuacagacccggcuaccacacccagaucgccggccccuggcaccugggcaagcuggagauggacuucgacuucugcgacggcaccaccgugaucgugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagguggacaacuucagccugggcgugcugggcauggcccuguuccuggaggagaugcugagaaccagagugggcaccaagcacgccauccugcugguggccgugagcuucgugacccugaucaccggcaacaugagcuucaaggaccugggcagagugguggugauggugggcgccaccauggccgacgacaucggcaugggcgugaccuaccuggcccugcuggccgccuucaaggugagacccaccuucgccgccggccugcugcugagaaagcugaccagcaaggagcugaugaugaccaccaucggcaucgugcugcugagccagagcaccauccccgagaccgugcuggagcugaccgacgcccuggcccugggcaugauggugcugaagaucgugagaaacauggagaaguaccagcuggccgugaccaucauggccauccugugcgugcccaacgccgugauccugcagaacgccuggaaggugagcugcaccauccuggccguggugagcgugagcccccugcugcugaccagcagccagcagaagaccgacuggaucccccuggcccugaccaucaagggccugaaccccaccgccaucuuccugaccacccugagcagaaccaacaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccaccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggccuguuccccaucagcauccccaucaccgccgccgccugguaccugugggaggugaagaagcagagagccggcgugcugugggacgugcccagccccccccccaugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacaagggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucaucgacaagaagggcaagguggugggccuguacggcaacggcguggugaccagaagcggcgccuacgugagcgccaucgcccagaccgagaagagcaccgaggacaaccccgagaucgaggacgacaucuucagaaagagaagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucaucgacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaagauggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaagaccagagacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcagaggcaucggcaagaugacccugggcaugugcugcaucaccaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucgccacccagcagcccgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggaccccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaugggcgagacccugggcgagaaguggaagagcagacugaacgcccugggcaagagcgaguuccagaucuacaagagaagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaucccccccgagaagugcgacacccugcugugcgacaucggcgagagcagccccaaccccaccguggaggccggcagaacccugagagugcugaaccugguggagaacuggcugaacaacaacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccagcggcaacaucgugagcagcgugaacaugaucagcagaaugcugaucaacagauucaccaugagacacaagaaggccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacgugcugcccaccgugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcagauucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacauggagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcguguucaagaacauccagcaccugaccgugaccgaggagguggccgugcagaacuggcuggccagagugggcagagagagacugagcagaauggccaucagcggcgacgacugcguggugaagccccuggacgacagauucgccaacgcccugaccgcccugaacgacaugggcaagaucagaaaggacauccagcagugggagcccagcaagggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugagagagaccgccugccugggcaagagcuacgcccagauguggagccugauguacuuccacagaagagaccugagacuggccgccaacgccaucugcagcgccgugcccagccacugggugcccaccagcagaaccaccuggagcauccacgccaagcacgaguggaugaccaccgaggacaugcugaccguguggaacagaguguggaucagagagaaccccuggauggaggacaagacccccguggagagcugggaggagauccccuaccugggcaagagagaggaccaguggugcggcagccugaucggccugaccagcagagccaccugggccaagaacauccaggccgccaucaaccaggugagaagccugaucggcaacgaggaguacaccgacuacaugcccagcaugaagagauucagaagagaggaggaggaggccggcgugcugugguga

SEQ ID NO: 17513 - RNA, 9876 nt, Artificial Sequence
  derived and/or modified CDS sequence (opt4) from DENV-2__EU482466__SS-prME
agcgccggcaugaucaucaugcugauccccaccgugauggccuuccaccugaccaccagaaacggcgagccccacaugaucgugggcauccaggagaagggcaagagccugcuguucaagaccgaggacggcgugaacaugugcacccugauggccauggaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgcccagagaaucgagaccuggauccugagacaccccggcuucaccaucauggccgccauccuggccuacaccaucggcaccacccacuuccagagagugcugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaaggaggagcaggacaagagauucgugugcaagcacagcaugguggacagaggcuggggcaacggcugcggccuguucggcaagggcggcaucgugaccugcgccauguucaccugcaagaagaacauggagggcaagaucgugcagcccgagaaccuggaguacaccaucguggugaccccccacagcggcgaggagcacgccgugggcaacgacaccggcaagcacggccaggagaucaaggugaccccccagagcagcaucaccgaggccgagcugaccggcuacggcaccgugaccauggagugcagccccagaaccggccuggacuucaacgagauggugcugcugcagauggagaacaaggccuggcuggugcacagacagugguuccuggaccugccccugcccuggcugcccggcgccgacaagcaggagagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucgugaucagagugcaguacgagggcgacggcagccccugcaagauccccuucgagaucauggaccuggagaagagauacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcaucgugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccaggaggagggcaucugcggcaucagaagcgugaccagacuggagaaccugauguggaagcagaucacccccgagcugaaccacauccuggccgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagcuacaaccagaccuuccugaucgacggccccgagaccgccgagugccccaacaccaacagagccuggaacagccuggagguggaggacuacggcuucggcguguucaccaccaacaucuggcugaagcugaaggagaagcaggacgccuucugcgacagcaagcugaugagcgccgccaucaaggacaacagagccgugcacgccgacaugggcuacuggaucgagagcgcccugaacgacaccuggaagaucgagaaggccagcuucaucgaggugaagaacugccacuggcccaagagccacacccuguggagcaacggcgugcuggagagcgagaugaucauccccaagaaccuggccggccccgugagccagcacaacuacagacccggcuaccacacccagaucgccggccccuggcaccugggcaagcuggagauggacuucgacuucugcgacggcaccaccgugaucgugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagguggacaacuucagccugggcgugcugggcauggcccuguuccuggaggagaugcugagaaccagagugggcaccaagcacgccauccugcugguggccgugagcuucgugacccugaucaccggcaacaugagcuucaaggaccugggcagagugguggugauggugggcgccaccauggccgacgacaucggcaugggcgugaccuaccuggcccugcuggccgccuucaaggugagacccaccuucgccgccggccugcugcugagaaagcugaccagcaaggagcugaugaugaccaccaucggcaucgugcugcugagccagagcaccauccccgagaccgugcuggagcugaccgacgcccuggcccugggcaugauggugcugaagaucgugagaaacauggagaaguaccagcuggccgugaccaucauggccauccugugcgugcccaacgccgugauccugcagaacgccuggaaggugagcugcaccauccuggccguggugagcgugagcccccugcugcugaccagcagccagcagaagaccgacuggaucccccuggcccugaccaucaagggccugaaccccaccgccaucuuccugaccacccugagcagaaccaacaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccaccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggccuguuccccaucagcauccccaucaccgccgccgccugguaccugugggaggugaagaagcagagagccggcgugcugugggacgugcccagcccccugcccaugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacaagggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucaucgacaagaagggcaagguggugggccuguacggcaacggcguggugaccagaagcggcgccuacgugagcgccaucgcccagaccgagaagagcaucgaggacaaccccgagaucgaggacgacaucuucagaaagagaagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucaucgacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaagauggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaagaccagagacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcagaggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucgccacccagcagcccgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggaccccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaugggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaucccccccgagaagugcgacacccugcugugcgacaucggcgagagcagccccaaccccaccguggaggccggcagaacccugagagugcugaaccugguggagaacuggcugaacaacaacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccagcggcaacaucgugagcagcgugaacaugaucagcagaaugcugaucaacagauucaccaugagacacaagaaggccaccuacgagcccgacguggaccugggcagcggcaccagaaacaucggcaucgagagcgagacccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacgugcugcccaccgugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcagauucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacauggagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcguguucaagaacauccagcaccugaccgugaccgaggagguggccgugcagaacuggcuggccagagugggcagagagagacugagcagaauggccaucagcggcgacgacugcguggugaagccccuggacgacagauucgccaacgcccugaccgcccugaacgacaugggcaagaucagaaaggacauccagcagugggagcccagcaagggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugagagagaccgccugccugggcaagagcuacgcccagauguggagccugauguacuuccacagaagagaccugagacuggccgccaacgccaucugcagcgccgugcccagccacugggugcccaccagcagaaccaccuggagcauccacgccaagcacgaguggaugaccaccgaggacaugcugaccguguggaacagaguguggaucagagagaaccccuggauggaggacaagacccccguggagagcugggaggagauccccuaccugggcaagagagaggaccaguggugcggcagccugaucggccugaccagcagagccaccugggccaagaacauccaggccgccaucaaccaggugagaagccugaucggcaacgaggaguacaccgacuacaugcccagcaugaagagauucagaagagaggaggaggaggccggcgugcugugguga

SEQ ID NO: 17514 - RNA, 9876 nt, Artificial Sequence
  derived and/or modified CDS sequence (opt4) from DENV-2__EU482467__SS-prME
agcgccggcaugaucaucaugcugauccccaccgugauggccuuccaccugaccaccagaaacggcgagccccacaugaucgugggcauccaggagaagggcaagagccugcuguucaagaccgaggacggcgugaacaugugcacccugauggccauggaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgcccagagaaucgagaccuggauccugagacaccccggcuucaccaucauggccgccauccuggccuacaccaucggcaccacccacuuccagagagugcugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaaggaggagcaggacaagagauucgugugcaagcacagcaugguggacagaggcuggggcaacggcugcggccuguucggcaagggcggcaucgugaccugcgccauguucaccugcaagaagaacauggagggcaagaucgugcagcccgagaaccuggaguacaccaucguggugaccccccacagcggcgaggagcacgccgugggcaacgacaccggcaagcacggcaaggagaucaaggugaccccccagagcagcaucaccgaggccgagcugaccggcuacggcaccgugaccauggagugcagccccagaaccggccuggacuucaacgagauggugcugcugcagauggagaacaaggccuggcuggugcacagacagugguuccuggaccugccccugcccuggcugcccggcgccgacaagcaggagagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucgugaucagagugcaguacgagggcgacggcagccccugcaagauccccuucgagaucauggaccuggagaagagauacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcaucgugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccaggaggagggcaucugcggcaucagaagcgugaccagacuggagaaccugauguggaagcagaucacccccgagcugaaccacauccuggccgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagcuacaaccagaccuuccugaucgacggccccgagaccgccgagugccccaacaccaacagagccuggaacagccuggagguggaggacuacggcuucggcguguucaccaccaacaucuggcugaagcugaaggagaagcaggacgccuucugcgacagcaagcugaugagcgccgccaucaaggacaacagagccgugcacgccgacaugggcuacuggaucgagagcgcccugaacgacaccuggaagaucgagaaggccagcuucaucgaggugaagaacugccacuggcccaagagccacacccuguggagcaacggcgugcuggagagcgagaugaucauccccaagaaccuggccggccccgugagccagcacaacuacagacccggcuaccacacccagaucgccggccccuggcaccugggcaagcuggagauggacuucgacuucugcgacggcaccaccgugaucgugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagguggacaacuucagccugggcgugcugggcauggcccuguuccuggaggagaugcugagaaccagagugggcaccaagcacgccauccugcugguggccgugagcuucgugacccugaucaccggcaacaugagcuucaaggaccugggcagagugguggugauggugggcgccaccauggccgacgacaucggcaugggcgugaccuaccuggcccugcuggccgccuucaaggugagacccaccuucgccgccggccugcugcugagaaagcugaccagcaaggagcugaugaugaccaccaucggcaucgugcugcugagccagagcaccauccccgagaccgugcuggagcugaccgacgcccuggcccugggcaugauggugcugaagaucgugagaaacauggagaaguaccagcuggccgugaccaucauggccauccugugcgugcccaacgccgugauccugcagaacgccuggaaggugagcugcaccauccuggccguggugagcgugagcccccugcugcugaccagcagccagcagaagaccgacuggaucccccuggcccugaccaucaagggccugaaccccaccgccaucuuccugaccacccugagcagaaccaacaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccaccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggccuguuccccaucagcauccccaucaccgccgccgccugguaccugugggaggugaagaagcagagagccggcgugcugugggacgugcccagccccccccccaugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacaagggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucaucgacaagaagggcaagguggugggccuguacggcaacggcguggugaccagaagcggcgccuacgugagcgccaucgcccagaccgagaagagcaucgaggacaaccccgagaucgaggacgacaucuucagaaagagaagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucaucgacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacaucaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaagauggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaagaccagagacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcagaggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucgccacccagcagcccgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggaccccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaugggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaucccccccgagaagugcgacacccugcugugcgacaucggcgagagcagccccaaccccaccguggaggccggcagaacccugagagugcugaaccugguggagaacuggcugaacaacaacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccagcggcaacaucgugagcagcgugaacaugaucagcagaaugcugaucaacagauucaccaugagacacaagaaggccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacgugcugcccaccgugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcagauucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacauggagggcgagcacagaaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcguguucaagaacauccaccaccugaccgugaccgaggagguggccgugcagaacuggcuggccagagugggcagagagagacugagcagaauggccaucagcggcgacgacugcguggugaagccccuggacgacagauucgccaacgcccugaccgcccugaacgacaugggcaagaucagaaaggacauccagcagugggagcccagcaagggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugagagagaccgccugccugggcaagagcuacgcccagauguggagccugauguacuuccacagaagagaccugagacuggccgccaacgccaucugcagcgccgugcccagccacugggugcccaccagcagaaccaccuggagcauccacgccaagcacgaguggaugaccaccgaggacaugcugaccguguggaacagaguguggaucagagagaaccccuggauggaggacaagacccccguggagagcugggaggagauccccuaccugggcaagagagaggaccaguggugcggcagccugaucggccugaccagcagagccaccugggccaagaacauccaggccgccaucaaccaggugagaagccugaucggcaacgaggaguacaccgacuacaugcccagcaugaagagauucagaagagaggaggaggaggccggcgugcugugguga

SEQ ID NO: 17515 - RNA, 9876 nt, Artificial Sequence
  derived and/or modified CDS sequence (opt4) from DENV-2__EU482468__SS-prME
agcgccggcaugaucaucaugcugauccccaccgugauggccuuccaccugaccaccagaaacggcgagccccacaugaucgugggcauccaggagaagggcaagagccugcuguucaagaccgaggacggcgugaacaugugcacccugauggccauggaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgcccagagaaucgagaccuggaucaugagacaccccggcuucaccaucauggccgccauccuggccuacaccaucggcaccacccacuuccagagagugcugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaaggaggagcaggacaagagauucgugugcaagcacagcaugguggacagaggcuggggcaacggcugcggccuguucggcaagggcggcaucgugaccugcgccauguucaccugcaagaagaacauggagggcaagaucgugcagcccgagaaccuggaguacaccaucguggugaccccccacagcggcgaggagcacgccgugggcaacgacaccggcaagcacggcaaggagaucaaggugaccccccagagcagcaucaccgaggccgagcugaccggcuacggcaccgugaccauggagugcagccccagaaccggccuggacuucaacgagauggugcugcugcagauggagaacaaggccuggcuggugcacagacagugguuccuggaccugccccugcccuggcugcccggcgccgacaagcaggagagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucgugaucagagugcaguacgagggcgacggcagccccugcaagauccccuucgagaucauggaccuggagaagagauacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcaucgugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccaggaggagggcaucugcggcaucagaagcgugaccagacuggagaaccugauguggaagcagaucacccccgagcugaaccacauccuggccgagaacgaggugaagcugaccaucaugaccggcgacaucagaggcaucaugcaggccggcaagagaagccugagaccccagcccaccgagcugaaguacagcuggaagaccuggggcaaggccaagaugcugagcaccgagagcuacaaccagaccuuccugaucgacggccccgagaccgccgagugccccaacaccaacagagccuggaacagccuggagguggaggacuacggcuucggcguguucaccaccaacaucuggcugaagcugaaggagaagcaggacgccuucugcgacagcaagcugaugagcgccgccaucaaggacaacagagccgugcacgccgacaugggcuacuggauggagagcgcccugaacgacaccuggaagaucgagaaggccagcuucaucgaggugaagaacugccacuggcccaagagccacacccuguggagcaacggcgugcuggagagcgagaugaucauccccaagaaccuggccggccccgugagccagcacaacuacagacccggcuaccacacccagaucgccggccccuggcaccugggcaagcuggagauggacuucgacuucugcgacggcaccaccgugaucgugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagguggacaacuucagccugggcgugcugggcauggcccuguuccuggaggagaugcugagaaccagagugggcaccaagcacgccauccugcugguggccgugagcuucgugacccugaucaccggcaacaugagcuucaaggaccugggcagagugguggugauggugggcgccaccauggccgacgacaucggcaugggcgugaccuaccuggcccugcuggccgccuucaaggugagacccaccuucgccgccggccugcugcugagaaagcugaccagcaaggagcugaugaugaccaccaucggcaucgugcugcugagccagagcaccauccccgagaccgugcuggagcugaccgacgcccuggcccugggcaugauggugcugaagaucgugagaaacauggagaaguaccagcuggccgugaccaucauggccauccugugcgugcccaacgccgugauccugcagaacgccuggaaggugagcugcaccauccuggccguggugagcgugagcccccugcugcugaccagcagccagcagaagaccgacuggaucccccuggcccugaccaucaagggccugaaccccaccgccaucuuccugaccacccugagcagaaccaacaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccaccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggccuguuccccaucagcauccccaucaccgccgccgccugguaccugugggaggugaagaagcagagagccggcgugcugugggacgugcccagccccccccccaugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacaagggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucaucgacaagaagggcaagguggugggccuguacggcaacggcguggugaccagaagcggcgccuacgugagcgccaucgcccagaccgagaagagcaucgaggacaaccccgagaucgaggacgacaucuucagaaagagaagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucaucgacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaagauggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaagaccagagacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcagaggcaucggcaagaugacccugggcaugugcugcaucaucaccgccagcacccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucgccacccagcagcccgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggaccccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaucccccccgagaagugcgacacccugcugugcgacaucggcgagagcagccccaaccccaccguggaggccggcagaacccugagagugcugaaccugguggagaacuggcugaacaacaacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccagcggcaacaucgugagcagcgugaacaugaucagcagaaugcugaucaacagauucaccaugagacacaagaaggccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacgugcugcccaccgugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcagauucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacauggagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcguguucaagaacauccagcaccugaccgugaccgaggagguggccgugcacaacuggcuggccagagugggcagagagagacugagcagaauggccaucagcggcgacgacugcguggugaagccccuggacgacagauucgccaacgcccugaccgcccugaacgacaugggcaagaucagaaaggacauccagcagugggagcccagcaagggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugagagagaccgccugccugggcaagagcuacgcccagauguggagccugauguacuuccacagaagagaccugagacuggccgccaacgccaucugcagcgccgugcccagccacugggugcccaccagcagaaccaccuggagcauccacgccaagcacgaguggaugaccaccgaggacaugcugaccguguggaacagaguguggaucagagagaaccccuggauggaggacaagacccccguggagagcugggaggagauccccuaccugggcaagagagaggaccaguggugcggcagccugaucggccugaccagcagagccaccugggccaagaacauccaggccgccaucaaccaggugagaagccugaucggcaacgaggaguacaccgacuacaugcccagcaugaagagauucagaagagaggaggaggaggccggcgugcugugguga

SEQ ID NO: 17516 - RNA, 9876 nt, Artificial Sequence
  derived and/or modified CDS sequence (opt4) from DENV-2__EU482469__SS-prME
agcgccggcaugaucaucaugcugauccccaccgugauggccuuccaccugaccaccagaaacggcgagccccacaugaucgugggcauccaggagaagggcaagagccugcuguucaagaccgaggacggcgugaacaugugcacccugauggccauggaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgcccagagaaucgagaccuggauccugagacaccccggcuucaccaucauggccgccauccuggcccacaccaucggcaccacccacuuccagagagugcugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaaggaggagcaggacaagagauucgugugcaagcacagcaugguggacagaggcuggggcaacggcugcggccuguucggcaagggcggcaucgugaccugcgccauguucaccugcaagaagaacauggagggcaagaucgugcagcccgagaaccuggaguacaccaucguggugaccccccacagcggcgaggagcacgccgugggcaacgacaccggcaagcacggcauggagaucaaggugaccccccagagcagcaucaccgaggccgagcugaccggcuacggcaccgugaccauggagugcagccccagaaccggccuggacuucaacgagauggugcugcugcagauggagaacaaggccuggcuggugcacagacagugguuccuggaccugccccugcccuggcugcccggcgccgacaagcaggagagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucgugaucagagugcaguacgagggcgacggcagccccugcaagauccccuucgagaucauggaccuggagaagagauacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcaucgugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccaggaggagggcaucugcggcaucagaagcgugaccagacuggagaaccugauguggaagcagaucacccccgagcugaaccacauccuggccgagaacgaggugaagcugaccaucaugaccggcgacaucagaggcaucaugcaggccggcaagagaagccugagaccccagcccaccgagcugaaguacagcuggaagaccuggggcaaggccaagaugcugagcaccgagagcuacaaccagaccuuccugaucgacggccccgagaccgccgagugccccaacaccaacagagccuggaacagccuggagguggaggacuacggcuucggcguguucaccaccaacaucuggcugaagcugaaggagaagcaggacgccuucugcgacagcaagcugaugagcgccgccaucaaggacaacagagccgugcacgccgacaugggcuacuggaucgagagcgcccugaacgacaccuggaagaucgagaaggccagcuucaucgaggugaagaacugccacuggcccaagagccacacccuguggagcaacggcgugcuggagagcgagaugaucauccccaagaaccuggccggccccgugagccagcacaacuacagacccggcuaccacacccagaucgccggccccuggcaccugggcaagcuggagauggacuucgacuucugcgacggcaccaccgugaucgugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagguggacaacuucagccugggcgugcugggcauggcccuguuccuggaggagaugcugagaaccagagugggcaccaagcacgccauccugcugguggccgugagcuucgugacccugaucaccggcaacaugagcuucaaggaccugggcagagugguggugauggugggcgccaccauggccgacgacaucggcaugggcgugaccuaccuggcccugcuggccgccuucaaggugagacccaccuucgccgccggccugcugcugagaaagcugaccagcaaggagcugaugaugaccaccaucggcaucgugcugcugagccagagcaccauccccgagaccgugcuggagcugaccgacgcccuggcccugggcaugauggugcugaagaucgugagaaacauggagaaguaccagcuggccgugaccaucauggccauccugugcgugcccaacgccgugauccugcagaacgccuggaaggugagcugcaccauccuggccguggugagcgugagcccccugcugcugaccagcagccagcagaagaccgacuggaucccccuggcccugaccaucaagggccugaaccccaccgccaucuuccugaccacccugagcagaaccaacaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccaccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggccuguuccccaucagcauccccaucaccgccgccgccugguaccugugggaggugaagaagcagagagccggcgugcugugggacgugcccagccccccccccaugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacaagggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucaucgacaagaagggcaagguggugggccuguacggcaacggcguggugaccagaagcggcgccuacgugagcgccaucgcccagaccgagaagaacaucgaggacaaccccgagaucgaggacgacaucuucagaaagagaagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucaucgacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaagauggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaagaccagagacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcagaggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucgccacccagcagcccgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggaccccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaccggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaucccccccgagaagugcgacacccugcugugcgacaucggcgagagcagccccaaccccaccguggaggccggcagaacccugagagugcugaaccugguggagaacuggcugaacaacaacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccagcggcaacaucgugagcagcgugaacaugaucagcagaaugcugaucaacagauucaccaugagacacaagaaggccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacgugcugcccaccgugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccaagaaggugagaagcaacgccgcccugggcgccaucuucaccgacgagaacaaguggaagagcgccagagaggccguggaggacagcagauucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacauggagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcguguucaagaacauccagcaccugaccgugaccgaggagguggccgugcacaacuggcuggccagagugggcagagagagacugagcagaauggccaucagcggcgacgacugcguggugaagccccuggacgacagauucgccaacgcccugaccgcccugaacgacaugggcaagaucagaaaggacauccagcagugggagcccagcaagggcuggaacgacuggacccaggugcccuucugcagccaccacuuccacgagcugaucaugaaggacggcagaauccugguggugcccugcagaaaccaggacgagcugaucggcagagccagaaucagccagggcgccggcuggagccugagagagaccgccugccugggcaagagcuacgcccagauguggagccugauguacuuccacagaagagaccugagacuggccgccaacgccaucugcagcgccgugcccagccacugggugcccaccagcagaaccaccuggagcauccacgccaagcacgaguggaugaccaccgaggacaugcugaccguguggaacagaguguggaucagagagaaccccuggauggaggacaagacccccguggagagcugggaggagauccccuaccugggcaagagagaggaccaguggugcggcagccugaucggccugaccagcagagccaccugggccaagaacauccaggccgccaucaaccaggugagaagccugaucggcaacgaggaguacaccgacuacaugcccagcaugaagagauucagaagagaggaggaggaggccggcgugcugugguga

SEQ ID NO: 17517 - RNA, 9876 nt, Artificial Sequence
  derived and/or modified CDS sequence (opt4) from DENV-2__EU482470__SS-prME
agcgccggcaugaucaucaugcugauccccaccgugauggccuuccaccugaccaccagaaacggcgagccccacaugaucgugggcauccaggagaagggcaagagccugcuguucaagaccgaggacggcgugaacaugugcacccugauggccauggaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgcccagagaaucgagaccuggauccugagacaccccggcuucaccaucauggccgccauccuggccuacaccaucggcaccacccacuuccagagagugcugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaaggaggagcaggacaagagauucgugugcaagcacagcaugguggacagaggcuggggcaacggcugcggccuguucggcaagggcggcaucgugaccugcgccauguucaccugcaagaagaacauggagggcaagaucgugcagcccgagaaccuggaguacaccaucguggugaccccccacagcggcgaggagcacgccgugggcaacgacaccggcaagcacggcaaggagaucaaggugaccccccagagcagcaucaccgaggccgagcugaccggcuacggcaccgugaccauggagugcagccccagaaccggccuggacuucaacgagauggugcugcugcagauggagaacaaggccuggcuggugcacagacagugguuccuggaccugccccugcccuggcugcccggcgccgacaagcaggagagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucgugaucagagugcaguacgagggcgacggcagccccugcaagauccccuucgagaucauggaccuggagaagagauacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcaucgugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccaggaggagggcaucugcggcaucagaagcgugaccagacuggagaaccugauguggaagcagaucacccccgagcugaaccacauccuggccgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagcuacaaccagaccuuccugaucgacggccccgagaccgccgagugccccaacaccaacagagccuggaacagccuggagguggaggacuacggcuucggcguguucaccaccaacaucuggcugaagcugaaggagaagcaggacgccuucugcgacagcaagcugaugagcgccgccaucaaggacaacagagccgugcacgccgacaugggcuacuggaucgagagcgcccugaacgacaccuggaagaucgagaaggccagcuucaucgaggugaagaacugccacuggcccaagagccacacccuguggagcaacggcgugcuggagagcgagaugaucauccccaagaaccuggccggccccgugagccagcacaacuacagacccggcuaccacacccagaucgccggccccuggcaccugggcaagcuggagauggacuucgacuucugcgacggcaccaccgugaucgugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagguggacaacuucagccugggcgugcugggcauggcccuguuccuggaggagaugcugagaaccagagugggcaccaagcacgccauccugcugguggccgugagcuucgugacccugaucaccggcaacaugagcuucaaggaccugggcagagugguggugauggugggcgccaccauggccgacgacaucggcaugggcgugaccuaccuggcccugcuggccgccuucaaggugagacccaccuucgccgccggccugcugcugagaaagcugaccagcaaggagcugaugaugaccaccaucggcaucgugcugcugagccagagcaccauccccgagaccgugcuggagcugaccgacgcccuggcccugggcaugauggugcugaagaucgugagaaacauggagaaguaccagcuggccgugaccaucaugaccauccugugcgugcccaacgccgugauccugcagaacgccuggaaggugagcugcaccauccuggccguggugagcgugagcccccugcugcugaccagcagcagacagaagaccgacuggaucccccuggcccugaccaucaagggccugaaccccaccgccaucuuccugaccacccugagcagaaccaacaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccaccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggccuguuccccaucagcauccccaucaccgccgccgccugguaccugugggaggugaagaagcagagagccggcgugcugugggacgugcccagccccccccccaugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacaagggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucaucgacaagaagggcaagguggugggccuguacggcaacggcguggugaccagaagcggcgccuacgugagcgccaucgcccagaccgagaagagcaucgaggacaaccccgagaucgaggacgacaucuucagaaagagaagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucaucgacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaagauggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaagaccagagacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcagaggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucgccacccagcagcccgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggaccccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaugggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaucccccccgagaagugcgacacccugcugugcgacaucggcgagagcagccccaaccccaccguggaggccggcagaacccugagagugcugaaccugguggagaacuggcugaacaacaacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccagcggcaacaucgugagcagcgugaacaugaucagcagaaugcugaucaacagauucaccaugagacacaagaaggccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacgugcugcccaccgugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcggcuucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacauggagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcguguucaagaacauccagcaccugaccgugaccgaggagguggccgugcagaacuggcuggccagagugggcagagagagacugagcagaauggccaucagcggcgacgacugcguggugaagccccuggacgacagauucgccaacgcccugaccgcccugaacgacaugggcaagaucagaaaggacauccagcagugggagcccagcaagggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugagagagaccgccugccugggcaagagcuacgcccagauguggagccugauguacuuccacagaagagaccugagacuggccgccaacgccaucugcagcgccgugcccagccacugggugcccaccagcagaaccaccuggagcauccacgccaagcacgaguggaugaccaccgaggacaugcugaccguguggaacagaguguggaucagagagaaccccuggauggaggacaagacccccguggagagcugggaggagauccccuaccugggcaagagagaggaccaguggugcggcagccugaucggccugaccagcagagccaccugggccaagaacauccaggccgccaucaaccaggugagaagccugaucggcaacgaggaguacaccgacuacaugcccagcaugaagagauucagaagagaggaggaggaggccggcgugcugugguga

SEQ ID NO: 17518 - RNA, 9876 nt, Artificial Sequence
  derived and/or modified CDS sequence (opt4) from DENV-2__EU482471__SS-prME
agcgccggcaugaucaucaugcugauccccaccgugauggccuuccaccugaccaccagaaacggcgagccccacaugaucgugggcauccaggagaagggcaagagccugcuguucaagaccgaggacggcgugaacaugugcacccugauggccauggaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgcccagagaaucgagaccuggauccugagacaccccggcuucaccaucauggccgccauccuggccuacaccaucggcaccacccacuuccagagagugcugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaaggaggagcaggacaagagauucgugugcaagcacagcaugguggacagaggcuggggcaacggcugcggccuguucggcaagggcggcaucgugaccugcgccauguucaccugcaagaagaacauggagggcaagaucgugcagcccgagaaccuggaguacaccaucguggugaccccccacagcggcgaggagcacagcgugggcaacgacaccggcaagcacggcauggagaucaaggugaccccccagagcagcaucaccgaggccgagcugaccggcuacggcaccgugaccauggagugcagccccagaaccggccuggacuucaacgagauggugcugcugcagauggagaacaaggccuggcuggugcacagacagugguuccuggaccugccccugcccuggcugcccggcgccgacaagcaggagagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucgugaucagagugcaguacgagggcgacggcagccccugcaagauccccuucgagaucauggaccuggagaagagauacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcaucgugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccaggaggagggcaucugcggcaucagaagcgugaccagacuggagaaccugauguggaagcagaucacccccgagcugaaccacauccuggccgagaacgaggugaagcugaccaucaugaccggcgacaucagaggcaucaugcaggccggcaagagaagccugagaccccagcccaccgagcugaaguacagcuggaagaccuggggcaaggccaagaugcugagcaccgagagcuacaaccagaccuuccugaucgacggccccgagaccgccgagugccccaacaccaacagagccuggaacagccuggagguggaggacuacggcuucggcguguucaccaccaacaucuggcugaagcugaaggagaagcaggacgccuucugcgacagcaagcugaugagcgccgccaucaaggacaacagagccgugcacgccgacaugggcuacuggaucgagagcgcccugaacgacaccuggaagaucgagaaggccagcuucaucgaggugaagaacugccacuggcccaagagccacacccuguggagcaacggcgugcuggagagcgagaugaucauccccaagaaccuggccggccccgugagccagcacaacuacagacccggcuaccacacccagaucgccggccccuggcaccugggcaagcuggagauggacuucgacuucugcgacggcaccaccgugaucgugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagguggacaacuucagccugggcgugcugggcauggcccuguuccuggaggagaugcugagaaccagagugggcaccaagcacgccauccugcugguggccgugagcuucgugacccugaucaccggcaacaugagcuucaaggaccugggcagagugguggugauggugggcgccaccauggccgacgacaucggcaugggcgugaccuaccuggcccugcuggccgccuucaaggugagacccaccuucgccgccggccugcugcugagaaagcugaccagcaaggagcugaugaugaccaccaucggcaucgugcugcugagccagagcaccauccccgagaccgugcuggagcugaccgacgcccuggcccugggcaugauggugcugaagaucgugagaaacauggagaaguaccagcuggccgugaccaucauggccauccugugcgugcccaacgccgugauccugcagaacgccuggaaggugagcugcaccauccuggccguggugagcgugagcccccugcugcugaccagcagccagcagaagaccgacuggaucccccuggcccugaccaucaagggccugaaccccaccgccaucuuccugaccacccugagcagaaccaacaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccaccaacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggccuguuccccaucagcauccccaucaccgccgccgccugguaccugugggaggugaagaagcagagagccggcgugcugugggacgugcccagccccccccccaugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacaagggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucaucgacaagaagggcaagguggugggccuguacggcaacggcguggugaccagaagcggcgccuacgugagcgccaucgcccagaccgagaagagcaucgaggacaaccccgagaucgaggacgacaucuucagaaagagaagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucaucgacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaagauggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaagaccagagacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcagaggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucgccacccagcagcccgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggaccccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaucccccccgagaagugcgacacccugcugugcgacaucggcgagagcagccccaaccccaccguggaggccggcagaacccugagagugcugaaccugguggagaacuggcugaacaacaacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccagcggcaacaucgugagcagcgugaacaugaucagcagaaugcugaucaacagauucaccaugagacacaagaaggccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacgugcugcccaccgugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcagauucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacauggagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcguguucaagaacauccagcaccugaccgugaccgaggagguggccgugcacaacuggcuggccagagugggcagagagagacugagcagaauggccaucagcggcgacgacugcguggugaagccccuggacgacagauucgccaacgcccugaccgcccugaacgacaugggcaagaucagaaaggacauccagcagugggagcccagcaagggcuggaacgacuggacccaggugcccuucugcagccaccacuuccacgagcugaucaugaaggacggcagaauccugguggugcccugcagaaaccaggacgagcugaucggcagagccagaaucagccagggcgccggcuggagccugagagagaccgccugccugggcaagagcuacgcccagauguggagccugauguacuuccacagaagagaccugagacuggccgccaacgccaucugcagcgccgugcccagccacugggugcccaccagcagaaccaccuggagcauccacgccaagcacgaguggaugaccaccgaggacaugcugaccguguggaacagaguguggaucagagagaaccccuggauggaggacaagacccccguggagagcugggaggagauccccuaccugggcaagagagaggaccaguggugcggcagccugaucggccugaccagcagagccaccugggccaagaacauccaggccgccaucaaccaggugagaagccugaucggcaacgaggaguacaccgacuacaugcccagcaugaagagauucagaagagaggaggaggaggccggcgugcugugguga

SEQ ID NO: 17519 - RNA, 9876 nt, Artificial Sequence
  derived and/or modified CDS sequence (opt4) from DENV-2__EU482472__SS-prME
agcgccggcaugaucaucaugcugauccccaccgugauggccuuccaccugaccaccagaaacggcgagccccacaugaucgugggcauccaggagaagggcaagagccugcuguucaagaccgaggacggcgugaacaugugcacccugauggccauggaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgcccagagaaucgagaccuggauccugagacaccccggcuucaccaucauggccgccauccuggccuacaccaucggcaccacccacuuccagagagugcugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaaggaggagcaggacaagagauucgugugcaagcacagcaugguggacagaggcuggggcaacggcugcggccuguucggcaagggcggcaucgugaccugcgccauguucaccugcaagaagaacauggagggcaagaucgugcagcccgagaaccuggaguacaccaucguggugaccccccacagcggcgaggagcacgccgugggcaacgacaccggcaagcacggcaaggagaucaaggugaccccccagagcagcaucaccgaggccgagcugaccggcuacggcaccgugaccauggagugcagccccagaaccggccuggacuucaacgagauggugcugcugcagauggagaacaaggccuggcuggugcacagacagugguuccuggaccugccccugcccuggcugcccggcgccgacaagcaggagagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucgugaucagagugcaguacgagggcgacggcagccccugcaagauccccuucgagaucauggaccuggagaagagauacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcaucgugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccaggaggagggcaucugcggcaucagaagcgugaccagacuggagaaccugauguggaagcagaucacccccgagcugaaccacauccuggccgagaacgaggugaagcugaccaucaugaccggcgacaucagaggcaucaugcaggccggcaagagaagccugagaccccagcccaccgagcugaaguacagcuggaagaccuggggcaaggccaagaugcugagcaccgagagcuacaaccagaccuuccugaucgacggccccgagaccgccgagugccccaacaccaacagagccuggaacagccuggagguggaggacuacggcuucggcguguucaccaccaacaucuggcugaagcugaaggagaagcaggacgccuucugcgacagcaagcugaugagcgccgccaucaaggacaacagagccgugcacgccgacaugggcuacuggauggagagcgcccugaacgacaccuggaagaucgagaaggccagcuucaucgaggugaagaacugccacuggcccaagagccacacccuguggagcaacggcgugcuggagagcgagaugaucauccccaagaaccuggccggccccgugagccagcacaacuacagacccggcuaccacacccagaucgccggccccuggcaccugggcaagcuggagauggacuucgacuucugcgacggcaccaccgugaucgugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagguggacaacuucagccugggcgugcugggcauggcccuguuccuggaggagaugcugagaaccagagugggcaccaagcacgccauccugcugguggccgugagcuucgugacccugaucaccggcaacaugagcuucaaggaccugggcagagugguggugauggugggcgccaccauggccgacgacaucggcaugggcgugaccuaccuggcccugcuggccgccuucaaggugagacccaccuucgccgccggccugcugcugagaaagcugaccagcaaggagcugaugaugaccaccaucggcaucgugcugcugagccagagcaccauccccgagaccgugcuggagcugaccgacgcccuggcccugggcaugauggugcugaagaucgugagaaacauggagaaguaccagcuggccgugaccaucauggccauccugugcgugcccaacgccgugauccugcagaacgccuggaaggugagcugcaccauccuggccguggugagcgugagcccccugcugcugaccagcagccagcagaagaccgacuggaucccccuggcccugaccaucaagggccugaaccccaccgccaucuuccugaccacccugagcagaaccaacaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccaccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggccuguuccccaucagcauccccaucaccgccgccgccugguaccugugggaggugaagaagcagagagccggcgugcugugggacgugcccagccccccccccaugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacaagggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaucaucggcgccgugagccuggacuucagccccggcaccagcggcagccccaucaucgacaagaagggcaagguggugggccuguacggcaacggcguggugaccagaagcggcgccuacgugagcgccaucgcccagaccgagaagagcaucgaggacaaccccgagaucgaggacgacaucuucagaaagagaagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucaucgacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaagauggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaagaccagagacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcagaggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucgccacccagcagcccgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggaccccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaucccccccgagaagugcgacacccugcugugcgacaucggcgagagcagccccaaccccaccguggaggccggcagaacccugagagugcugaaccugguggagaacuggcugaacaacaacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccagcggcaacaucgugagcagcgugaacaugaucagcagaaugcugaucaacagauucaccaugagacacaagaaggccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacgugcugcccaccgugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcagauucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacauggagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcguguucaagaacauccagcaccugaccgugaccgaggagguggccgugcacaacuggcuggccagagugggcagagagagacugagcagaauggccaucagcggcgacgacugcguggugaagccccuggacgacagauucgccaacgcccugaccgcccugaacgacaugggcaagaucagaaaggacauccagcagugggagcccagcaagggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugagagagaccgccugccugggcaagagcuacgcccagauguggagccugauguacuuccacagaagagaccugagacuggccgccaacgccaucugcagcgccgugcccagccacugggugcccaccagcagaaccaccuggagcauccacgccaagcacgaguggaugaccaccgaggacaugcugaccguguggaacagaguguggaucagagagaaccccuggauggaggacaagacccccguggagagcugggaggagauccccuaccugggcaagagagaggaccaguggugcggcagccugaucggccugaccagcagagccaccugggccaagaacauccaggccgccaucaaccaggugagaagccugaucggcaacgaggaguacaccgacuacaugcccagcaugaagagauucagaagagaggaggaggaggccggcgugcugugguga

SEQ ID NO: 17520 - RNA, 9876 nt, Artificial Sequence
  derived and/or modified CDS sequence (opt4) from DENV-2__EU482473__SS-prME
agcgccggcaugaucaucaugcugauccccaccgugauggccuuccaccugaccaccagaaacggcgagccccacaugaucgugggcauccaggagaagggcaagagccugcuguucaagaccgaggacggcgugaacaugugcacccugauggccauggaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgcccagagaaucgagaccuggauccugagacaccccggcuucaccaucauggccgccauccuggccuacaccaucggcaccacccacuuccagagagugcugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaaggaggagcaggacaagagauucgugugcaagcacagcaugguggacagaggcuggggcaacggcugcggccuguucggcaagggcggcaucgugaccugcgccauguucaccugcaagaagaacauggagggcaagaucgugcagcccgagaaccuggaguacaccaucguggugaccccccacagcggcgaggagcacgccgugggcaacgacaccggcaagcacggccaggagaucaaggugaccccccagagcagcaucaccgaggccgagcugaccggcuacggcaccgugaccauggagugcagccccagaaccggccuggacuucaacgagauggugcugcugcagauggagaacaaggccuggcuggugcacagacagugguuccuggaccugccccugcccuggcugcccggcgccgacaagcaggagagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucgugaucagagugcaguacgagggcgacggcagccccugcaagauccccuucgagaucauggaccuggagaagagauacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcaucgugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccaggaggagggcaucugcggcaucagaagcgugaccagacuggagaaccugauguggaagcagaucacccccgagcugaaccacauccuggccgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagcuacaaccagaccuuccugaucgacggccccgagaccgccgagugccccaacaccaacagagccuggaacagccuggagguggaggacuacggcuucggcguguucaccaccaacaucuggcugaagcugaaggagaagcaggacgccuucugcgacagcaagcugaugagcgccgccaucaaggacaacagagccgugcacgccgacaugggcuacuggaucgagagcgcccugaacgacaccuggaagaucgagaaggccagcuucaucgaggugaagaacugccacuggcccaagagccacacccuguggagcaacggcgugcuggagagcgagaugaucauccccaagaaccuggccggccccgugagccagcacaacuacagacccggcuaccacacccagaucgccggccccuggcaccugggcaagcuggagauggacuucgacuucugcgacggcaccaccgugaucgugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagguggacaacuucagccugggcgugcugggcauggcccuguuccuggaggagaugcugagaaccagagugggcaccaagcacgccauccugcugguggccgugagcuucgugacccugaucaccggcaacaugagcuucaaggaccugggcagagugguggugauggugggcgccaccauggccgacgacaucggcaugggcgugaccuaccuggcccugcuggccgccuucaaggugagacccaccuucgccgccggccugcugcugagaaagcugaccagcaaggagcugaugaugaccaccaucggcaucgugcugcugagccagagcaccauccccgagaccgugcuggagcugaccgacgcccuggcccugggcaugauggugcugaagaucgugagaaacauggagaaguaccagcuggccgugaccaucauggccauccugugcgugcccaacgccgugauccugcagaacgccuggaaggugagcugcaccauccuggccguggugagcgugagcccccugcugcugaccagcagccagcagaagaccgacuggaucccccuggcccugaccaucaagggccugaaccccaccgccaucuuccugaccacccugagcagaaccaacaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccaccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggccuguuccccaucagcauccccaucaccgccgccgccugguaccugugggaggugaagaagcagagagccggcgugcugugggacgugcccagccccccccccaugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacaagggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucaucgacagaaagggcaagguggugggccuguacggcaacggcguggugaccagaagcggcgccuacgugagcgccaucgcccagaccgagaagagcaucgaggacaaccccgagaucgaggacgacaucuucagaaagagaagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucaucgacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaagauggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaagaccagagacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcagaggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucgccacccagcagcccgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggaccccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaugggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaucccccccgagaagugcgacacccugcugugcgacaucggcgagagcagccccaaccccaccguggaggccggcagaacccugagagugcugaaccugguggagaacuggcugaacaacaacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccagcggcaacaucgugagcagcgugaacaugaucagcagaaugcugaucaacagauucaccaugagacacaagaaggccaccuacgagcccgacguggaccugggcagcggcaccagaaacaucggcaucgagagcgagacccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacgugcugcccaccgugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcagauucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacauggagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcguguucaagaacauccagcaccugaccgugaccgaggagguggccgugcagaacuggcuggccagagugggcagagagagacugagcagaauggccaucagcggcgacgacugcguggugaagccccuggacgacagauucgccaacgcccugaccgcccugaacgacaugggcaagaucagaaaggacauccagcagugggagcccagcaagggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugagagagaccgccugccugggcaagagcuacgcccagauguggagccugauguacuuccacagaagagaccugagacuggccgccaacgccaucugcagcgccgugcccagccacugggugcccaccagcagaaccaccuggagcauccacgccaagcacgaguggaugaccaccgaggacaugcugaccguguggaacagaguguggaucagagagaaccccuggauggaggacaagacccccguggagagcugggaggagauccccuaccugggcaagagagaggaccaguggugcggcagccugaucggccugaccagcagagccaccugggccaagaacauccagguggccaucaaccaggugagaagccugaucggcaacgaggaguacaccgacuacaugcccagcaugaagagauucagaagagaggaggaggaggccggcgugcugugguga

SEQ ID NO: 17521 - RNA, 9876 nt, Artificial Sequence
  derived and/or modified CDS sequence (opt4) from DENV-2__EU482474__SS-prME
agcgccggcaugaucaucaugcugauccccaccgugauggccuuccaccugaccaccagaaacggcgagccccacaugaucgugggcauccaggagaagggcaagagccugcuguucaagaccgaggacggcgugaacaugugcacccugauggccauggaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgcccagagaaucgagaccuggauccugagacaccccggcuucaccaucauggccgccauccuggccuacaccaucggcaccacccacuuccagagagugcugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaaggaggagcaggacaagagauucgugugcaagcacagcaugguggacagaggcuggggcaacggcugcggccuguucggcaagggcggcaucgugaccugcgccauguucaccugcaagaagaacauggagggcaagaucgugcagcccgagaaccuggaguacaccaucguggugaccccccacagcggcgaggagcacgccgugggcaacgacaccggcaagcacggcaaggagaucaaggugaccccccagagcagcaucaccgaggccgagcugaccggcuacggcaccgugaccauggagugcagccccagaaccggccuggacuucaacgagauggugcugcugcagauggagaacaaggccuggcuggugcacagacagugguuccuggaccugccccugcccuggcugcccggcgccgacaagcaggagagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucgugaucagagugcaguacgagggcgacggcagccccugcaagauccccuucgagaucauggaccuggagaagagauacgugcugggcagacugaucaccgugaaccccaucgugaccgagaaggacagccccaucaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcaucgugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccaggaggagggcaucugcggcaucagaagcgugaccagacuggagaaccugauguggaagcagaucacccccgagcugaaccacauccuggccgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucaccaccaacaucuggcugagacugaaggagaagcaggacgccuucugcgacagcaagcugaugagcgccgccaucaaggacaacagagccgugcacgccgacaugggcuacuggaucgagagcgcccugaacgacaccuggaagaucgagaaggccagcuucaucgaggugaagaacugccacuggcccaagagccacacccuguggagcaacggcgugcuggagagcgagaugaucauccccaagaaccuggccggccccgugagccagcacaacuacagacccggcuaccacacccagaucgccggccccuggcaccugggcaagcuggagauggacuucgacuucugcgacggcaccaccgugaucgugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagguggacaacuucagccugggcgugcugggcauggcccuguuccuggaggagaugcugagaaccagagugggcaccaagcacgccauccugcugguggccgugagcuucgugacccugaucaccggcaacaugagcuucaaggaccugggcagagugguggugauggugggcgccaccauggccgacgacaucggcaugggcgugaccuaccuggcccugcuggccgccuucaaggugagacccaccuucgccgccggccugcugcugagaaagcugaccagcaaggagcugaugaugaccaccaucggcaucgugcugcugagccagagcaccauccccgagaccgugcuggagcugaccgacgcccuggcccugggcaugauggugcugaagaucgugagaaacauggagaaguaccagcuggccgugaccaucauggccauccugugcgugcccaacgccgugauccugcagaacgccuggaaggugagcugcaccauccuggccguggugagcgugagcccccugcugcugaccagcagccagcagaagaccgacuggaucccccuggcccugaccaucaagggccugaaccccaccgccaucuuccugaccacccugagcagaaccaacaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccaccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggccuguuccccaucagcauccccaucaccgccgccgccugguaccugugggaggugaagaagcagagagccggcgugcugugggacgugcccagccccccccccaugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacaagggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucaucgacaagaagggcaagguggugggccuguacggcaacggcguggugaccagaagcggcgccuacgugagcgccaucgcccagaccgagaagagcaucgaggacaaccccgagaucgaggacgacaucuucagaaagagaagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucaucgacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccguggacggcgaguacagacugagaggcgaggccagaaagaccuucguggaccugaugagaagaggcgaccugcccguguggcuggccuacaagguggccgccgagggcaucaacuacgccgacagaagauggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaagaccagagacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcagaggcaucggcaagaugacccugggcaugugcugcaucgugaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucgccacccagcagcccgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggaccccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaugggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaucccccccgagaagugcgacacccugcugugcgacaucggcgagagcagccccaaccccaccguggaggccggcagaacccugagagugcugaaccugguggagaacuggcugaacaacaacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccagcggcaacaucgugagcagcgugaacaugaucagcagaaugcugaucaacagauucaccaugagacacaagaaggccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacgugcugcccaccgugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcagauucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacauggagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcguguucaagaacauccagcaccugaccgugaccgaggagguggccgugcagaacuggcuggccagagugggcagagagagacugagcagaauggccaucagcggcgacgacugcguggugaagccccuggacgacagauucgccaacgcccugaccgcccugaacgacaugggcaagaucagaaaggacauccagcagugggagcccagcaagggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugagagagaccgccugccugggcaagagcuacgcccagauguggagccugauguacuuccacagaagagaccugagacuggccgccaacgccaucugcagcgccgugcccagccacugggugcccaccagcagaaccaccuggagcauccacgccaagcacgaguggaugaccaccgaggacaugcugaccguguggaacagaguguggaucagagagaaccccuggauggaggacaagacccccguggagagcugggaggagauccccuaccugggcaagagagaggaccaguggugcggcagccugaucggccugaccagcagagccaccugggccaagaacauccaggccgccaucaaccaggugagaagccugaucggcaacgaggaguacaccgacuacaugcccagcaugaagagauucagaagagaggaggaggaggccggcgugcugugguga

SEQ ID NO: 17522 - RNA, 9876 nt, Artificial Sequence
  derived and/or modified CDS sequence (opt4) from DENV-2__EU482475__SS-prME
agcgccggcaugaucaucaugcugauccccaccgugauggccuuccaccugaccaccagaaacggcgagccccacaugaucgugggcauccaggagaagggcaagagccugcuguucaagaccgaggacggcgugaacaugugcacccugauggccauggaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgcccagagaaucgagaccuggauccugagacaccccggcuucaccaucauggccgccauccuggccuacaccaucggcaccacccacuuccagagagugcugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaaggaggagcaggacaagagauucgugugcaagcacagcaugguggacagaggcuggggcaacggcugcggccuguucggcaagggcggcaucgugaccugcgccauguucaccugcaagaagaacauggagggcaagaucgugcagcccgagaaccuggaguacaccaucguggugaccccccacagcggcgaggagcacgccgugggcaacgacaccggcaagcacggcaaggagaucaaggugaccccccagagcagcaucaccgaggccgagcugaccggcuacggcaccgugaccauggagugcagccccagaaccggccuggacuucaacgagauggugcugcugcagauggagaacaaggccuggcuggugcacagacagugguuccuggaccugccccugcccuggcugcccggcgccgacaagcaggagagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucgugaucagagugcaguacgagggcgacggcagccccugcaagauccccuucgagaucauggaccuggagaagagauacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcaucgugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccaggaggagggcaucugcggcaucagaagcgugaccagacuggagaaccugauguggaagcagaucacccccgagcugaaccacauccuggccgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagcuacaaccagaccuuccugaucgacggccccgagaccgccgagugccccaacaccaacagagccuggaacagccuggagguggaggacuacggcuucggcguguucaccaccaacaucuggcugaagcugaaggagaagcaggacgccuucugcgacagcaagcugaugagcgccgccaucaaggacaacagagccgugcacgccgacaugggcuacuggaucgagagcgcccugaacgacaccuggaagaucgagaaggccagcuucaucgaggugaagaacugccacuggcccaagagccacacccuguggagcaacggcgugcuggagagcgagaugaucauccccaagaaccuggccggccccgugagccagcacaacuacagacccggcuaccacacccagaucgccggccccuggcaccugggcaagcuggagauggacuucgacuucugcgacggcaccaccgugaucgugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagguggacaacuucagccugggcgugcugggcauggcccuguuccuggaggagaugcugagaaccagagugggcaccaagcacgccauccugcugguggccgugagcuucgugacccugaucaccggcaacaugagcuucaaggaccugggcagagugguggugauggugggcgccaccauggccgacgacaucggcaugggcgugaccuaccuggcccugcuggccgccuucaaggugagacccaccuucgccgccggccugcugcugagaaagcugaccagcaaggagcugaugaugaccaccaucggcaucgugcugcugagccagagcaccauccccgagaccgugcuggagcugaccgacgcccuggcccugggcaugauggugcugaagaucgugagaaacauggagaaguaccagcuggccgugaccaucauggccauccugugcgugcccaacgccgugauccugcagaacgccuggaaggugagcugcaccauccuggccguggugagcgugagcccccugcugcugaccagcagccagcagaagaccgacuggaucccccuggcccugaccaucaagggccugaaccccaccgccaucuuccugaccacccugagcagaaccaacaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccaccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggccuguuccccaucagcauccccaucaccgccgccgccugguaccugugggaggugaagaagcagagagccggcgugcugugggacgugcccagccccccccccaugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacaagggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucaucgacaagaagggcaagguggugggccuguacggcaacggcguggugaccagaagcggcgccuacgugagcgccaucgcccagaccgagaagagcaucgaggacaaccccgagaucgaggacgacaucuucagaaagagaagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucaucgacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacguggacagaagauggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaagaccagagacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcagaggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucgccacccagcagcccgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggaccccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaugggcgagacccugggcgagaaguggaagagcagacugaacgcccugggcaagagcgaguuccagaucuacaagagaagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaucccccccgagaagugcgacacccugcugugcgacaucggcgagagcagccccaaccccaccguggaggccggcagaacccugagagugcugaaccugguggagaacuggcugaacaacaacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccagcggcaacaucgugagcagcgugaacaugaucagcagaaugcugaucaacagauucaccaugagacacaagaaggccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacgugcugcccaccgugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcagauucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacaugaagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcguguucaagaacauccagcaccugaccgugaccgaggagguggccgugcagaacuggcuggccagagugggcagagagagacugagcagaauggccaucagcggcgacgacugcguggugaagccccuggacgacagauucgccaacgcccugaccgcccugaacgacaugggcaagaucagaaaggacauccagcagugggagcccagcaagggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugagagagaccgccugccugggcaagagcuacgcccagauguggagccugauguacuuccacagaagagaccugagacuggccgccaacgccaucugcagcgccgugcccagccacugggugcccaccagcagaaccaccuggagcauccacgccaagcacgaguggaugaccaccgaggacaugcugaccguguggaacagaguguggaucagagagaaccccuggauggaggacaagacccccguggagagcugggaggagauccccuaccugggcaagagagaggaccaguggugcggcagccugaucggccugaccagcagagccaccugggccaagaacauccaggccgccaucaaccaggugagaagccugaucggcaacgaggaguacaccgacuacaugcccagcaugaagagauucagaagagaggaggaggaggccggcgugcugugguga

SEQ ID NO: 17523 - RNA, 9876 nt, Artificial Sequence
  derived and/or modified CDS sequence (opt4) from DENV-2__EU482541__SS-prME
agcgccggcaugaucaucaugcugauccccaccgugauggccuuccaccugaccaccagaaacggcgagccccacaugaucgugggcauccaggagaagggcaagagccugcuguucaagaccgaggacggcgugaacaugugcacccugauggccauggaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgcccagagaaucgagaccuggauccugagacaccccggcuucaccaucauggccgccauccuggccuacaccaucggcaccacccacuuccagagagugcugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaaggaggagcaggacaagagauucgugugcaagcacagcaugguggacagaggcuggggcaacggcugcggccuguucggcaagggcggcaucgugaccugcgccauguucaccugcaagaagaacauggagggcaagaucgugcagcccgagaaccuggaguacaccaucguggugaccccccacagcggcgaggagcacgccgugggcaacgacaccggcaagcacggcauggagaucaaggugaccccccagagcagcaucaccgaggccgagcugaccggcuacggcaccgugaccauggagugcagccccagaaccggccuggacuucaacgagauggugcugcugcagauggagaacaaggccuggcuggugcacagacagugguuccuggaccugccccugcccuggcugcccggcgccgacaagcaggagagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucgugaucagagugcaguacgagggcgacggcagccccugcaagauccccuucgagaucauggaccuggagaagagauacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcaucgugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccaggaggagggcaucugcggcaucagaagcgugaccagacuggagaaccugauguggaagcagaucacccccgagcugaaccacauccuggccgagaacgaggugaagcugaccaucaugaccggcgacaucagaggcaucaugcaggccggcaagagaagccugagaccccagcccgccgagcugaaguacagcuggaagaccuggggcaaggccaagaugcugagcaccgagagcuacaaccagaccuuccugaucgacggccccgagaccgccgagugccccaacaccaacagagccuggaacagccuggagguggaggacuacggcuucggcguguucaccaccaacaucuggcugaagcugaaggagaagcaggacgccuucugcgacagcaagcugaugagcgccgccaucaaggacaacagagccgugcacgccgacaugggcuacuggaucgagagcgcccugaacgacaccuggaagaucgagaaggccagcuucaucgaggugaagaacugccacuggcccaagagccacacccuguggagcaacggcgugcuggagagcgagaugaucauccccaagaaccuggccggccccgugagccagcacaacuacagacccggcuaccacacccagaucgccggccccuggcaccugggcaagcuggagauggacuucgacuucugcgacggcaccaccgugaucgugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagguggacaacuucagccugggcgugcugggcauggcccuguuccuggaggagaugcugagaaccagagugggcaccaagcacgccauccugcugguggccgugagcuucgugacccugaucaccggcaacaugagcuucaaggaccugggcagagugguggugauggugggcgccaccauggccgacgacaucggcaugggcgugaccuaccuggcccugcuggccgccuucaaggugagacccaccuucgccgccggccugcugcugagaaagcugaccagcaaggagcugaugaugaccaccaucggcaucgugcugcugagccagagcaccauccccgagaccgugcuggagcugaccgacgcccuggcccugggcaugauggugcugaagaucgugagaaacauggagaaguaccagcuggccgugaccaucauggccauccugugcgugcccaacgccgugauccugcagaacgccuggaaggugagcugcaccauccuggccguggugagcgugagcccccugcugcugaccagcagccagcagaagaccgacuggaucccccuggcccugaccaucaagggccugaaccccaccgccaucuuccugaccacccugagcagaaccaacaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccaccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggccuguuccccaucagcauccccaucaccgccgccgccugguaccugugggaggugaagaagcagagagccggcgugcugugggacgugcccagccccccccccaugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacaagggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucaucgacaagaagggcaagguggugggccuguacggcaacggcguggugaccagaagcggcgccuacgugagcgccaucgcccagaccgagaagagcaucgaggacaaccccgagaucgaggacgacaucuucagaaagagaagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucaucgacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaagauggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaagaccagagacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcagaggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucgccacccagcagcccgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggaccccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaucccccccgagaagugcgacacccugcugugcgacaucggcgagagcagccccaaccccaccguggaggccggcagaacccugagagugcugaaccugguggagaacuggcugaacaacaacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccagcggcaacaucgugagcagcgugaacaugaucagcagaaugcugaucaacagauucaccaugagacacaagaaggccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacgugcugcccaccgugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcagauucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacauggagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcguguucaagaacauccagagacugaccgugaccgaggagguggccgugcacaacuggcuggccagagugggcagagagagacugagcagaauggccaucagcggcgacgacugcguggugaagccccuggacgacagauucgccaacgcccugaccgcccugaacgacaugggcaagaucagaaaggacauccagcagugggagcccagcaagggcuggaacgacuggacccaggugcccuucugcagccaccacuuccacgagcugaucaugaaggacggcagaauccugguggugcccugcagaaaccaggacgagcugaucggcagagccagaaucagccagggcgccggcuggagccugagagagaccgccugccugggcaagagcuacgcccagauguggagccugauguacuuccacagaagagaccugagacuggccgccaacgccaucugcagcgccgugcccagccacugggugcccaccagcagaaccaccuggagcauccacgccaagcacgaguggaugaccaccgaggacaugcugaccguguggaacagaguguggaucagagagaaccccuggauggaggacaagacccccguggagagcugggaggagauccccuaccugggcaagagagaggaccaguggugcggcagccugaucggccugaccagcagagccaccugggccaagaacauccaggccgccaucaaccaggugagaagccugaucggcaacgaggaguacaccgacuacaugcccagcaugaagagauucagaagagaggaggaggaggccggcgugcugugguga

SEQ ID NO: 17524 - RNA, 9876 nt, Artificial Sequence
  derived and/or modified CDS sequence (opt4) from DENV-2__EU482542__SS-prME
agcgccggcaugaucaucaugcugauccccaccgugauggccuuccaccugaccaccagaaacggcgagccccacaugaucgugggcauccaggagaagggcaagagccugcuguucaagaccgaggacggcgugaacaugugcacccugauggccauggaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgcccagagaaucgagaccuggauccugagacaccccggcuucaccaucauggccgccauccuggccuacaccaucggcaccacccacuuccagagagugcugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaaggaggagcaggacaagagauucgugugcaagcacagcaugguggacagaggcuggggcaacggcugcggccuguucggcaagggcggcaucgugaccugcgccauguucaccugcaagaagaacauggagggcaagaucgugcagcccgagaaccuggaguacaccaucguggugaccccccacagcggcgaggagcacgccgugggcaacgacaccggcaagcacggccaggagaucaaggugaccccccagagcagcaucaccgaggccgagcugaccggcuacggcaccgugaccauggagugcagccccagaaccggccuggacuucaacgagauggugcugcugcagauggagaacaaggccuggcuggugcacagacagugguuccuggaccugccccugcccuggcugcccggcgccgacaagcaggagagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucgugaucagagugcaguacgagggcgacggcagccccugcaaggugcccuucgagaucauggaccuggagaagagauacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcaucgugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccaggaggagggcaccugcggcaucagaagcgugaccagacuggagaaccugauguggaagcagaucacccccgagcugaaccacauccuggccgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagcuacaaccagaccuuccugaucgacggccccgagaccgccgagugccccaacaccaacagagccuggaacagccuggagguggaggacuacggcuucggcguguucaccaccaacaucuggcugaagcugaaggagaagcaggacgccuucugcgacagcaagcugaugagcgccgccaucaaggacaacagagccgugcacgccgacaugggcuacuggaucgagagcgcccugaacgacaccuggaagaucgagaaggccagcuucaucgaggugaagaacugccacuggcccaagagccacacccuguggagcaacggcgugcuggagagcgagaugaucauccccaagaaccuggccggccccgugagccagcacaacuacagacccggcuaccacacccagaucgccggccccuggcaccugggcaagcuggagauggacuucgacuucugcgacggcaccaccgugaucgugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagguggacaacuucagccugggcgugcugggcauggcccuguuccuggaggagaugcugaagaccagagugggcaccaagcacgccauccugcugguggccgugagcuucgugacccugaucaccggcaacaugagcuucaaggaccugggcagagugguggugauggugggcgccaccauggccgacgacaucggcaugggcgugaccuaccuggcccugcuggccgccuucaaggugagacccaccuucgccgccggccugcugcugagaaagcugaccagcaaggagcugaugaugaccaccaucggcaucgugcugcugagccagagcaccauccccgagaccgugcuggagcugaccgacgcccuggcccugggcaugauggugcugaagaucgugagaaacauggagaaguaccagcuggccgugaccaucauggccauccugugcgugcccaacgccgugauccugcagaacgccuggaaggugagcugcaccauccuggccguggugagcgugagcccccugcugcugaccagcagccagcagaagaccgacuggaucccccuggcccugaccaucaagggccugaaccccaccgccaucuuccugaccacccugagcagaaccaacaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccaccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggccuguuccccaucagcauccccaucaccgccgccgccugguaccugugggaggugaagaagcagagagccggcgugcugugggacgugcccagccccccccccaugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacaagggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucaucgacaagaagggcaagguggugggccuguacggcaacggcguggugaccagaagcggcgccuacgugagcgccaucgcccagaccgagaagagcaucgaggacaaccccgagaucgaggacgacaucuucagaaagagaagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucaucgacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaagauggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaagaccagagacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucgccacccagcagcccgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggaccccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaugggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaucccccccgagaagugcgacacccugcugugcgacaucggcgagagcagccccaaccccaccguggaggccggcagaacccugagagugcugaaccugguggagaacuggcugaacaacaacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccagcggcaacaucgugagcagcgugaacaugaucagcagaaugcugaucaacagauucaccaugagacacaagaaggccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacgugcugcccaccgugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcagauucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacauggagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcguguucaagaacauccagcaccugaccgugaccgaggagguggccgugcagaacuggcuggccagagugggcagagagagacugagcagaauggccaucagcggcgacgacugcguggugaagccccuggacgacagauucgccaacgcccugaccgcccugaacgacaugggcaagaucagaaaggacauccagcagugggagcccagcaagggcuggaacgacuggacccaggugcccuucugcagccaccacuuccacgagcugaucaugaaggacggcagaauccugguggugcccugcagaaaccaggacgagcugaucggcagagccagaaucagccagggcgccggcuggagccugagagagaccgccugccugggcaagagcuacgcccagauguggagccugauguacuuccacagaagagaccugagacuggccgccaacgccaucugcagcgccgugcccagccacugggugcccaccagcagaaccaccuggagcauccacgccaagcacgaguggaugaccaccgaggacaugcugaccguguggaacagaguguggaucagagagaaccccuggauggaggacaagacccccguggagagcugggaggagauccccuaccugggcaagagagaggaccaguggugcggcagccugaucggccugaccagcagagccaccugggccaagaacauccaggccgccaucaaccaggugagaagccugaucggcaacgaggaguacaccgacuacaugcccagcaugaagagauucagaagagaggaggaggaggccggcgugcugugguga

SEQ ID NO: 17525 - RNA, 9876 nt, Artificial Sequence
  derived and/or modified CDS sequence (opt4) from DENV-2__JX966380__SS-prME
accgccggcaugaucaucaugcugauccccaccgugauggccuuccaccugaccaccagaaacggcgagccccacaugaucgugagcagacaggagaagggcaagagccugcuguucaagaccaaggacggcaccaacaugugcacccugauggccauggaccugggcgagcugugcgaggacaccaucaccuacaagugccccuuccugaagcagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgcccagagaaucgagaccuggauccugagacaccccggcuucaccaucauggccgccauccuggccuacaccaucggcaccacccacuuccagagagugcugaucuucauccugcugaccgccaucgcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgacagcagaugccccacccagggcgagcccacccugaacgaggagcaggacaagagauucgugugcaagcacagcaugguggacagaggcuggggcaacggcugcggccuguucggcaagggcggcaucgugaccugcgccauguucaccugcaagaagaacauggagggcaagaucgugcagcccgagaaccuggaguacaccguggugaucaccccccacagcggcgaggagcacgccgugggcaacgacaccggcaagcacggcaaggaggugaagaucaccccccagagcagcaucaccgaggccgagcugaccggcuacggcaccgugaccauggagugcagccccagaaccggccuggacuucaacgagauggugcugcugcagaugaaggacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagaucgugaaggagaucgccgagacccagcacggcaccaucgugaucagagugcaguacgagggcgacggcagccccugcaagauccccuucgagaucauggaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcuggacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcaucgugacccuguaccugggcgugauggugcaggccgacagcggcugcguggugagcuggaagaacaaggagcugaagugcggcagcggcaucuucgugaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucaccagcgagcugaaccacauccugagcgagaacgaggugaagcugaccaucaugaccggcgacaucaagggcaucaugcaggugggcaagagaagccugagaccccagcccaccgagcugagauacagcuggaagaccuggggcaaggccaagacccugagcaccgagcugcacaaccagaccuuccugaucgacggccccgagaccgccgagugccccaacaccaacagagccuggaacagccuggagguggaggacuacggcuucggcguguucaccaccaacaucuggcugagacugagagagaagcaggacguguucugcgacagcaagcugaugagcgccgccaucaaggacaacagagccgugcacgccgacaugggcuacuggaucgagagcgcccugaacgacaccuggaagaucgagaaggccagcuucaucgaggugaagagcugccacuggcccaagagccacacccuguggagcaacggcgugcuggagagcgagauggugauccccaagaacuucgccggccccgugagccagcacaacaacagacccggcuaccacacccagaccgccggccccuggcaccugggcaagcuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugagcagccuggugaccgccggccacggccagaucgacaacuucagccugggcauccugggcauggcccuguuccuggaggagaugcugagaaccagagugggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucaccgccggccugcugcugagaaagcugaccagcaaggagcugaugaugaccaccaucggcaucgugcugcugagccagagcagcauccccgagaccauccuggagcugaccgacgcccuggcccugggcaugauggugcugaagauggugagaaacauggagaaguaccagcuggccgugaccaucauggccauccugugcgugcccaacgccgugauccugcagaacgccuggaaggugagcugcaccauccuggccguggugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccaccgacgugaagugggacgaccaggccgagaucagcggcagcagccccauccugagcaucaccaucagcgaggacggcagcaugagcaucaagaacgaggaggaggagcagacccugaccauccugaucagaaccggccugcuggugaucagcggccuguuccccgugagcauccccaucaccgccgccgccugguaccugugggaggugaagaagcagagagccggcgugcugugggacgugcccagccccccccccgugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacaagggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucagaaccaacaccggcaccaucggcgccgugagccuggacuucagccccggcaccagcggcagccccaucguggacaagaagggcaagguggugggccuguacggcaacggcguggugaccagaagcggcgccuacgugagcgccaucgcccagaccgagaagagcaucgaggacaaccccgagaucgaggacgacaucuucagaaagagaagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccaucagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaagaccggcaacgacaucgccgccugccugagaaagaacggcaagagagugauccagcugagcagaaagaccuucgacagcgaguacgugaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccagaaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaagauggugcuucgacggcaccagaaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagagacgcccuggacaaccuggccgugcugcacaccgccgaggccggcggcaaggccuacaaccacgcccugagcgagcugcccgagacccuggagacccugcugcugcugacccugcuggccaccgugaccggcggcaucuuccuguuccugaugagcggcagaggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacgugaucaucgccauccugaccgugguggccgccaccauggccaacgagaugggcuuccuggagaagaccaagaaggaccugggccugggcaacaucgccacccagcagcccgagagcaacauccuggacaucgaccugagacccgccagcgccuggacccuguacgccguggccaccaccuucaucacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggaccccauccccuacgaccccaaguucgagaagcagcugggccaggugaugcugcuggugcugugcgugacccaggugcugaugaugagaaccaccugggcccugugcgaggcccugacccuggccaccggccccgugagcacccugugggagggcaaccccggcagauucuggaacaccaccaucgccgugagcauggccaacaucuucagaggcagcuaccuggccggcgccggccugcuguucagcaucaugaagaacaccaccagcaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaaccuggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucgugccccccgagaagugcgacacccugcugugcgacaucggcgagagcagccccaaccccaccguggaggccggcagaacccugagagugcugaaccugguggagaacuggcugaacaacaacacccaguucugcgugaaggugcugaaccccuacaugcccagcgugaucgagagaauggagacccugcagagaaaguacggcggcgcccuggugagaaacccccugagcagaaacagcacccacgagauguacugggugagcaacgccagcggcaacaucgugagcagcgugaacaugaucagcagaaugcugaucaacagauucaccaugagacacaagaaggccaccuacgagcccgacguggaccugggcagcggcaccagaaacaucggcaucgagagcgagacccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacguggugcccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccaagaaggugagaagcaacgccgcccugggcgccaucuucaccgacgagaacaaguggaagagcgccagagaggccguggaggacagcagauucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagaggugagcaagaaggagggcggcgccauguacgccgacgacaccgccggcugggacaccagaaucaccaucgaggaccugaagaacgaggagaugaucaccaaccacauggccggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcaucuucaagaacauccagcaccugaccgccagcgaggagaucgccgugcaggacuggcuggugagagugggcagagagagacugagcagaauggccaucagcggcgacgacugcguggugaagccccuggacgacagauucgccagagcccugaccgcccugaacgacaugggcaaggugagaaaggacauccagcagugggagcccagcagaggcuggaacgacuggacccaggugcccuucugcagccaccacuuccacgagcugaucaugaaggacggcagaacccugguggugcccugcagaaaccaggacgagcugaucggcagagccagaaucagccagggcgccggcuggagccugagagagaccgccugccugggcaagagcuacgcccagauguggagccugauguacuuccacagaagagaccugagacuggccgccaacgccaucugcagcgccgugcccagccacugggugcccaccagcagaaccaccuggagcauccacgccagccacgaguggaugaccaccgaggacaugcugaccguguggaacaagguguggauccuggagaaccccuggauggaggacaagacccccguggagagcugggaggagauccccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 17526 - RNA, 9876 nt, Artificial Sequence
  derived and/or modified CDS sequence (opt4) from DENV-2__JX966379__SS-prME
accgccggcaugaucaucaugcugauccccaccgugauggccuuccaccugaccaccagaaacggcgagccccacaugaucgugagcagacaggagaagggcaagagccugcuguucaagaccaaggacggcaccaacaugugcacccugauggccauggaccugggcgagcugugcgaggacaccaucaccuacaagugccccuuccugaagcagaacgagcccgaggacaucgacugcuggugcaacagcaccagcaccugggugaccuacggcaccugcaccaccaccggcgagcacagaagaggcaagagaagcguggcccuggugccccacgugggcaugggccuggagaccagaaccgagaccuggaugagcagcgagggcgccuggaagcacgcccagagaaucgagaccuggauccugagacaccccggcuucaccaucauggccgccauccuggccuacaccaucggcaccacccacuuccagagagugcugaucuucauccugcugaccgccaucgcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccagccugagaaaguacugcaucgaggccaagcugaccaacaccaccaccgacagcagaugccccacccagggcgagcccacccugaacgaggagcaggacaagagauucgugugcaagcacagcaugguggacagaggcuggggcaacggcugcggccuguucggcaagggcggcaucgugaccugcgccauguucaccugcaagaagaacauggagggcaagaucgugcagcccgagaaccuggaguacaccguggugaucaccccccacagcggcgaggagcacgccgugggcaacgacaccggcaagcacggcaaggaggugaagaucaccccccagagcagcaucaccgaggccgagcugaccggcuacggcaccgugaccauggagugcagccccagaaccggccuggacuucaacgagauggugcugcugcagauggaggacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagaucgugaaggagaucgccgagacccagcacggcaccaucgugaucagagugcaguacgagggcgacggcagccccugcaagauccccuucgagaucauggaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcuggacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcaucgugacccuguaccugggcgugauggugcaggccgacagcggcugcguggugagcuggaagaacaaggagcugaagugcggcagcggcaucuucgugaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggugggcaagagaagccugagaccccagcccaccgagcugagauacagcuggaagaccuggggcaaggccaagaugcugagcaccgagcugcacaaccagaccuuccugaucgacggccccgagaccgccgagugccccaacaccaacagagccuggaacagccuggagguggaggacuacggcuucggcguguucaccaccaacaucuggcugagacugagagagaagcaggacguguucugcgacagcaagcugaugagcgccgccaucaaggacaacagagccgugcacgccgacaugggcuacuggaucgagagcgcccugaacgacaccuggaagaucgagaaggccagcuucaucgaggugaagagcugccacuggcccaagagccacacccuguggagcaacggcgugcuggagagcgagauggugauccccaagaacuacgccggccccgugagccagcacaacaacagacccggcuaccacacccagaccgccggccccuggcaccugggcaagcuggagauggacuucgacuucugcgagggcaccaccgugguggugaccgaggagugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugagcagccuggugaccgccggccacggccagaucgacaacuucagccugggcauccugggcauggcccuguuccuggaggagaugcugagaagcagagugggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuacaaggugagacccaccuucgccgccggccugcugcugagaaagcugaccagcaaggagcugaugaugaccaccaucggcaucgugcugcugagccagagcagcauccccgagaccauccuggagcugaccgacgcccuggcccugggcaugauggugcugaagauggugagaaacauggagaaguaccagcuggccgugaccaucauggccauccugugcgugcccaacgccgugauccugcagaacgccuggaaggugagcugcaccacccuggccguggugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccaccgacgugaagugggacgaccaggccgagaucagcggcagcagccccauccugagcaucaccaucagcgaggacggcagcaugagcaucaagaacgaggaggaggagcagacccugaccauccugaucagaaccggccugcuggugaucagcggccuguuccccgugagcacccccaucaccgccgccgccugguaccugugggaggugaagaagcagagagccggcgugcugugggacgugcccagccccccccccgugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacaagggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucagaaccaacaccggcaccaucggcgccgugagccuggacuucagccccggcaccagcggcagccccaucguggacaagaagggcaagguggugggccuguacggcaacggcguggugaccagaagcggcgccuacgugagcgccaucgcccagaccgagaagagcaucgaggacaaccccgagaucgaggacgacaucuucagaaagagaagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccaucagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccaccugccugagaaagaacggcaagagagugauccagcugagcagaaagaccuucgacagcgaguacgugaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccagaaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccagcgagggcaucaacuacgccgacagaagauggugcuucgacggcaccagaaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagagacgcccuggacaaccuggccgugcugcacaccgccgaggccggcggcaaggccuacaaccacgcccugagcgagcugcccgagacccuggagacccugcugcugcugacccugcuggccaccgugaccggcggcaucuuccuguuccugaugagcggcagaggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacgugaucaucgccauccugaccgugguggccgccaccauggccaacgagaugggcuuccuggagaagaccaagaaggaccugggccugggccacaucgccacccagcagcccgagagcaacauccuggacaucgaccugagacccgccagcgccuggacccuguacgccguggccaccaccuucaucacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggaccccauccccuacgaccccaaguucgagaagcagcugggccaggugaugcugcuggugcugugcgugacccaggugcugaugaugagaaccaccugggcccugugcgaggcccugacccuggccaccggccccgugagcacccugugggagggcaaccccggcagauucuggaacaccaccaucgccgugagcauggccaacaucuucagaggcagcuaccuggccggcgccggccugcuguucagcaucaugaagaacaccaccagcaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaaccuggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucgugccccccgagaagugcgacacccugcugugcgacaucggcgagagcagccccaaccccaccguggaggccggcagaacccugagagugcugaaccugguggagaacuggcugaacgacaacacccaguucugcgugaaggugcugaaccccuacaugcccagcgugaucgagagaauggagacccugcagagaaaguacggcggcgcccuggugagaaacccccugagcagaaacagcacccacgagauguacugggugagcaacgccagcggcaacguggugagcagcgugaacaugaucagcagaaugcugaucaacagauucaccaugagacacaagaaggccaccuacgagcccgacguggaccugggcagcggcaccagaaacaucggcaucgagagcgagacccccaaccuggacaucaucggcaagagaaucgagaagaucaagcaggagcacgaggccagcuggcacuacgaccaggaccaccccuacaagaccugggccuaccacggcagcuacgagaccaagcagaccggcagcgccagcagcauggugaacggcguggugagacugcugaccaagcccugggacguggugcccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccaagaaggugagaagcaacgccgcccugggcgccaucuucaccgacgagaacaaguggaagagcgccagagaggccguggaggacaacagauucugggagcugguggacaaggagagaaaccugcaccuggagggcaagugcgagaccugcguguacaacaugaugggcaagagagagaagaagcugggcgaguucggcaaggccagaggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagaggugagcaagaaggagggcggcgccauguacgccgacgacaccgccggcugggacaccagaaucaccaucgaggaccugaagaacgaggagaugaucaccaaccacauggccggcgagcacaagaagcuggccgaggccaucuucaagcugaccuaccagaacaagguggugagagugcagagacccacccccagaggcaccgugauggacaucaucagcagaagagaccagagaggcagcggccagguggugaccuacggccugaacaccuucaccaacauggaggcccagcugaucagacagauggagggcgagggcaucuucaagagcauccagcaccugaccgccagcgaggagaucgccgugcaggacuggcuggccagagugggcagagagagacugagcagaauggccaucagcggcgacgacugcguggugaagccccuggacgacagauucgccagagcccugaccgcccugaacgacaugggcaaggugagaaaggacauccagcagugggagcccagcagaggcuggaacgacuggacccaggugcccuucugcagccaccacuuccacgagcugaucaugaaggacggcagaacccugguggugcccugcagaaaccaggacgagcugaucggcagagccagaaucagccagggcgccggcuggagccugagagagaccgccugccugggcaagagcuacgcccagauguggagccugauguacuuccacagaagagaccugagacuggccgccaacgccaucugcagcgccgugcccagccacugggugcccaccagcagaaccaccuggagcauccacgccagccacgaguggaugaccaccgaggacaugcugaccguguggaacagaguguggauccuggagaaccccuggauggaggacaagacccccguggagagcugggaggagauccccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 17527 - RNA, 9876 nt, Artificial Sequence
  derived and/or modified CDS sequence (opt4) from DENV-2__KP012546__SS-prME
accgccggcaucaucaucaugaugauccccaccgugauggccuuccaccugaccaccagaaacggcgagccccacaugaucgugagcagacaggagaagggcaagagccugcuguucaagaccgagaacggcgugaacaugugcacccugauggccauggaccugggcgagcugugcgaggacaccaucaccuacaacugcccccugcugagacagaacgagcccgaggacaucgacugcuggugcaacagcaccagcaccugggugaccuacggcaccugcaccgccaccggcgagcacagaagagagaagagaagcguggcccuggugccccacgugggcaugggccuggagaccagaaccgagaccuggaugagcagcgagggcgccuggaagcacgcccagagaaucgagaccugggugcugagacaccccggcuucaccaucauggccgccauccuggccuacaccaucggcaccaccuacuuccagagagugcugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcaccccgccacccugagaaaguacugcaucgaggccaagcugaccaacaccaccaccgccagcagaugccccacccagggcgagcccagccugaacgaggagcaggacaagagauucgugugcaagcacagcaugguggacagaggcuggggcaacggcugcggccuguucggcaagggcggcaucgugaccugcgccauguucaccugcaagaagaacauggagggcaagaucgugcagcccgagaaccuggaguacaccaucgugaucaccccccacagcggcgaggagaacgccgugggcaacgacaccggcaagcacggcaaggagaucaaggugaccccccagagcagcaucaccgaggccgagcugaccggcuacggcaccgugaccauggagugcagccccagaaccggccuggacuucaacgagauggugcugcugcagauggagaacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucgugaucagagugcaguacgagggcgacggcagccccugcaagauccccuucgagaucauggaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugagcugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcguggugaucaccuggaucggcaugaacagcagaagcaccagccugagcgugagccuggugcuggugggcguggugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagcugcacaaccacaccuuccugaucgacggccccgagaccgccgagugccccaacaccaacagagccuggaacagccuggagguggaggacuacggcuucggcguguucaccaccaacaucuggcugaagcugaaggagagacaggacguguucugcgacagcaagcugaugagcgccgccaucaaggacaacagagccgugcacgccgacaugggcuacuggaucgagagcgcccugaacgacaccuggaagaucgagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcagacuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugguggccgugagcuucgugacccugaucaccggcaacaugagcuucagagaccugggcagagugauggugauggugggcgccgccaugaccgacgacaucggcaugggcgugaccuaccuggcccugcuggccgccuucaaggugagacccaccuucgccgccggccugcugcugagaaagcugaccagcaaggagcugaugaugaccaccaucggcaucgugcugcugagccagagcaccaugcccgagaccauccuggagcugaccgacgcccuggcccugggcaugauggugcugaagaucgugagaaacauggagaaguaccagcuggccgugaccaucauggccauccugugcgugcccaacgccgugauccugcagaacgccuggaaggugagcugcaccacccuggccguggugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugagaugggaggagcaggccgagaucagcggcagcagccccauccugagcaucaccaucagcgaggacggcagcaugagcaucaagaacgaggaggaggagcagacccugaccauccugaucagaaccggccugcuggugaucagcggccuguuccccgugagcauccccaucaccgccgccgccugguaccugugggaggugaagaagcagagagccggcgugcugugggacgugcccagccccccccccgugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacaagggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucguggacaagaagggcaagguggugggccuguacggcaacggcguggugaccagaagcggcaccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccaucagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacaucaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagagugggcagaaaccccaagaacgagaacgaccaguacaucuacaugggcgagccccuggagaacgacgaggacugcgcccacuggaaggaggccaagaugcugcuggacaacaucagcacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacagaguggccgccgagggcaucaacuacgccgacagaagauggugcuucgacggcgugaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagaaacgcccuggacaaccuggccgugcugcacaccgccgaggccggcggcagagccuacaaccacgcccugagcgagcugcccgagacccuggagacccugcugcugcugacccugcuggccgccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggacuucggccugggcagcaccaccacccagcagcccgagagcaacauccuggacaucgaccugagacccgccagcgccuggacccuguacgccguggccaccaccuucaucacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggaccccauccccuacgaccccaaguucgagaagcagcugggccaggugaugcugcuggugcugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccgccaacaccagaagaggcaccggcaacaccggcgagacccugggcgagaaguggaagaacagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaaccuggugacccccgagggcaaggugguggaccugggcugcggcagaggcggcuggagcuacuacugcggcggccugaagaacgugaaggaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccguggaggccggcagaacccugagagugcugaaccugguggagaacuggcugaacaacaacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccagcggcaacaucgugagcagcgugaacaugaucagcagaaugcugaucaacagauucaccaugagacacaagaaggccaccuacgagcccgacguggaccugggcagcggcaccagaaacaucggcaucgagagcgagacccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacgugauccccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcggcuucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacauggagggcgagcacaagaagcuggccgaggccaucuucaagcugaccuaccagaacaagguggugagagugcagagacccacccccagaggcaccgugauggacaucaucagcagaagagaccagagaggcagcggccagguggugaccuacggccugaacaccuucaccaacauggaggcccagcugaucagacagauggagggcgagggcguguucaagagcauccagcagcugaccgugaccgaggagaucgccgugaagaacuggcuggugagagugggcagagagagacugagcagaauggccaucagcggcgacgacugcguggugaagccccuggacgacagauucgccagcgcccugaccgcccugaacgacaugggcaaggugagaaaggacauccagcagugggagcccagcagaggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugagagagaccgccugccugggcaagagcuacgcccagauguggaaccugauguacuuccacagaagagaccugagacuggccgccaacgccaucugcagcgccgugcccagccacugggugcccaccagcagaaccaccuggagcauccacgccacccacgaguggaugaccaccgaggacaugcugaccguguggaacagaguguggauccaggagaaccccuggauggaggacaagacccccguggagagcugggaggagauccccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 17528 - RNA, 9876 nt, Artificial Sequence
  derived and/or modified CDS sequence (opt4) from DENV-2__KP723478__SS-prME
accgccggcaucaucaucaugaugauccccaccgugauggccuuccaccugaccaccagaaacggcgagccccacaugaucgugagcagacaggagaagggcaagagccugcuguucaagaccgagaacggcgugaacaugugcacccugauggccauggaccugggcgagcugugcgaggacaccaucaccuacaacugcccccugcugagacagaacgagcccgaggacaucgacugcuggugcaacagcaccagcaccugggugaccuacggcaccugcaccgccaccggcgagcacagaagagagaagagaagcguggcccuggugccccacgugggcaugggccuggagaccagaaccgagaccuggaugagcagcgagggcgccuggaagcacgcccagagaaucgagaccugggugcugagacaccccggcuucaccaucauggccgccauccuggccuacaccaucggcaccaccuacuuccagagagugcugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcaccccgccacccugagaaaguacugcaucgaggccaagcugaccaacaccaccaccgccagcagaugccccacccagggcgagcccagccugaacgaggagcaggacaagagauucgugugcaagcacagcaugguggacagaggcuggggcaacggcugcggccuguucggcaagggcggcaucgugaccugcgccauguucaccugcaagaagaacauggagggcaagaucgugcagcccgagaaccuggaguacaccaucgugaucaccccccacagcggcgaggagaacgccgugggcaacgacaccggcaagcacggcaaggagaucaaggugaccccccagagcagcaucaccgaggccgagcugaccggcuacggcaccgugaccauggagugcagccccagaaccggccuggacuucaacgagauggugcugcugcagauggagaacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucgugaucagagugcaguacgagggcgacggcagccccugcaagauccccuucgagaucauggaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugagcugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcguggugaucaccuggaucggcaugaacagcagaagcaccagccugagcgugagccuggugcuggugggcguggugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagcugcacaaccacaccuuccugaucgacggccccgagaccgccgagugccccaacaccaacagagccuggaacagccuggagguggaggacuacggcuucggcguguucaccaccaacaucuggcugaagcugaaggagagacaggacguguucugcgacagcaagcugaugagcgccgccaucaaggacaacagagccgugcacgccgacaugggcuacuggaucgagagcgcccugaacgacaccuggaagaucgagaaggccagcuucaucgaggugaagagcugccacuggcccaagagccacacccuguggagcaacggcgugcuggagagcgagaugaucauccccaagaacuucgccggccccaugagccagcacaacuacagacccggcuaccacacccagaccgccggccccuggcaccugggcagacuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugguggccgugagcuucgugacccugaucaccggcaacaugagcuucagagaccugggcagagugauggugauggugggcgccgccaugaccgacgacaucggcaugggcgugaccuaccuggcccugcuggccgccuucaaggugagacccaccuucgccgccggccugcugcugagaaagcugaccagcaaggagcugaugaugaccaccaucggcaucgugcugcugagccagagcaccaugcccgagaccauccuggagcugaccgacgcccuggcccugggcaugauggugcugaagaucgugagaaacauggagaaguaccagcuggccgugaccaucauggccauccugugcgugcccaacgccgugauccugcagaacgccuggaaggugagcugcaccacccuggccguggugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugagaugggaggagcaggccgagaucagcggcagcagccccauccugagcaucaccaucagcgaggacggcagcaugagcaucaagaacgaggaggaggagcagacccugaccauccugaucagaaccggccugcuggugaucagcggccuguuccccgugagcacccccaucaccgccgccgccugguaccugugggaggugaagaagcagagagccggcgugcugugggacgugcccagccccccccccgugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacaagggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucguggacaagaagggcaagguggugggccuguacggcaacggcguggugaccagaagcggcaccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccaucagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacaucaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagagugggcagaaaccccaagaacgagaacgaccaguacaucuacaugggcgagccccuggagaacgacgaggacugcgcccacuggaaggaggccaagaugcugcuggacaacaucagcacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacagaguggccgccgagggcaucaacuacgccgacagaagauggugcuucgacggcgugaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagaaacgcccuggacaaccuggccgugcugcacaccgccgaggccggcggcagagccuacaaccacgcccugagcgagcugcccgagacccuggagacccugcugcugcugacccugcuggccgccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggacuucggccugggcagcaccaccacccagcagcccgagagcaacauccuggacaucgaccugagacccgccagcgccuggacccuguacgccguggccaccaccuucaucacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggaccccauccccuacgaccccaaguucgagaagcagcugggccaggugaugcugcuggugcugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccgccaacaccagaagaggcaccggcaacaccggcgagacccugggcgagaaguggaagaacagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaaccuggugacccccgagggcaaggugguggaccugggcugcggcagaggcggcuggagcuacuacugcggcggccugaagaacgugaaggaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccguggaggccggcagaacccugagagugcugaaccugguggagaacuggcugaacaacaacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccagcggcaacaucgugagcagcgugaacaugaucagcagaaugcugaucaacagauucaccaugagacacaagaaggccaccuacgagcccgacguggaccugggcagcggcaccagaaacaucggcaucgagagcgagacccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacgugauccccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcggcuucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacauggagggcgagcacaagaagcuggccgaggccaucuucaagcugaccuaccagaacaagguggugagagugcagagacccacccccagaggcaccgugauggacaucaucagcagaagagaccagagaggcagcggccagguggugaccuacggccugaacaccuucaccaacauggaggcccagcugaucagacagauggagggcgagggcguguucaagagcauccagcagcugaccgugaccgaggagaucgccgugaagaacuggcuggugagagugggcagagagagacugagcagaauggccaucagcggcgacgacugcguggugaagccccuggacgacagauucgccagcgcccugaccgcccugaacgacaugggcaaggugagaaaggacauccagcagugggagcccagcagaggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugagagagaccgccugccugggcaagagcuacgcccagauguggaaccugauguacuuccacagaagagaccugagacuggccgccaacgccaucugcagcgccgugcccagccacugggugcccaccagcagaaccaccuggagcauccacgccacccacgaguggaugaccaccgaggacaugcugaccguguggaacagaguguggauccaggagaaccccuggauggaggacaagacccccguggagagcugggaggagauccccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 17529 - RNA, 9876 nt, Artificial Sequence
  derived and/or modified CDS sequence (opt4) from DENV-2__KP723479__SS-prME
accgccggcaucaucaucaugaugauccccaccgugauggccuuccaccugaccaccagaaacggcgagccccacaugaucgugagcagacaggagaagggcaagagccugcuguucaagaccgagaacggcgugaacaugugcacccugauggccauggaccugggcgagcugugcgaggacaccaucaccuacaacugcccccugcugagacagaacgagcccgaggacaucgacugcuggugcaacagcaccagcaccugggugaccuacggcaccugcaccgccaccggcgagcacagaagagagaagagaagcguggcccuggugccccacgugggcaugggccuggagaccagaaccgagaccuggaugagcagcgagggcgccuggaagcacgcccagagaaucgagaccugggugcugagacaccccggcuucaccaucauggccgccauccuggccuacaccaucggcaccaccuacuuccagagagugcugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcaccccgccacccugagaaaguacugcaucgaggccaagcugaccaacaccaccaccgccagcagaugccccacccagggcgagcccagccugaacgaggagcaggacaagagauucgugugcaagcacagcaugguggacagaggcuggggcaacggcugcggccuguucggcaagggcggcaucgugaccugcgccauguucaccugcaagaagaacauggagggcaagaucgugcagcccgagaaccuggaguacaccaucgugaucaccccccacagcggcgaggagaacgccgugggcaacgacaccggcaagcacggcaaggagaucaaggugaccccccagagcagcaucaccgaggccgagcugaccggcuacggcaccgugaccauggagugcagccccagaaccggccuggacuucaacgagauggugcugcugcagauggagaacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucgugaucagagugcaguacgagggcgacggcagccccugcaagauccccuucgagaucauggaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugagcugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcguggugaucaccuggaucggcaugaacagcagaagcaccagccugagcgugagccuggugcuggugggcguggugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaaggccuggggcaaggccaagaugcugagcaccgagcugcacaaccacaccuuccugaucgacggccccgagaccgccgagugccccaacaccaacagagccuggaacagccuggagguggaggacuacggcuucggcguguucaccaccaacaucuggcugaagaugaaggagagacaggacguguucugcgacagcaagcugaugagcgccgccaucaaggacagcagagccgugcacgccgacaugggcuacuggaucgagagcgcccugaacgacaccuggaagaucgagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcagacuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugaugaccaccaucggcaucgugcugcugagccaggccaccauccccgagaccauccuggagcugaccgacgcccuggcccugggcaugauggugcugaagaucgugagaaacauggagaaguaccagcuggccgugaccaucauggccauccugugcgugcccaacgccgugauccugcagaacgccuggaaggugagcugcaccacccuggccguggugagcgugagcccccugcugcugaccagcagccagcagaaggccgacuggaucccccuggcccugaccaucaagggccugaaccccaccgccaucuuccugaccacccugagcagaaccaacaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugagaugggaggagcaggccgagaucagcggcagcagccccauccugagcaucaccaucagcgaggacggcagcaugagcaucaagaacgaggaggaggagcagacccugaccauccugaucagaaccggccugcugguggugagcggccuguuccccgugagcacccccaucaccgccgccgccugguaccugugggaggugaagaagcagagagccggcgugcugugggacgugcccagccccccccccgugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacaagggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucguggacaagaagggcaagguggugggccuguacggcaacggcguggugaccagaagcggcaccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccaucagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacaucaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagagugggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacagaguggccgccgagggcaucaacuacgccgacagaagauggugcuucgacggcgugaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagaaacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggacuucggccugggcagcaucaccacccagcagcccgagaacaacauccuggacaucgaccugagacccgccagcgccuggacccuguacgccguggccaccaccuucaucacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggaccccauccccuacgaccccaaguucgagaagcagcugggccaggugaugcugcuggugcugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccgccaacaccagaagaggcaccggcaacaccggcgagacccugggcgagaaguggaagaacagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaaccuggugacccccgagggcaaggugguggaccugggcugcggcagaggcggcuggagcuacuacugcggcggccugaagaacgugaaggaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccguggaggccggcagaacccugagagugcugaaccugguggagaacuggcugaacaacaacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccagcggcaacaucgugagcagcgugaacaugaucagcagaaugcugaucaacagauucaccaugagacacaagaaggccaccuacgagcccgacguggaccugggcagcggcaccagaaacaucggcaucgagagcgagacccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacgugauccccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcggcuucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacauggagggcgagcacaagaagcuggccgaggccaucuucaagcugaccuaccagaacaagguggugagagugcagagacccacccccagaggcaccgugauggacaucaucagcagaagagaccagagaggcagcggccagguggugaccuacggccugaacaccuucaccaacauggaggcccagcugaucagacagauggagggcgagggcguguucaagagcauccagcagcugaccgugaccgaggagaucgccgugaagaacuggcuggugagagugggcagagagagacugagcagaauggccaucagcggcgacgacugcguggugaagccccuggacgacagauucgccagcgcccugaccgcccugaacgacaugggcaaggugagaaaggacauccagcagugggagcccagcagaggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugagagagaccgccugccugggcaagagcuacgcccagauguggagccugauguacuuccacagaagagaccugagacuggccgccaacgccaucugcagcgccgugcccagccacugggugcccaccagcagaaccaccuggagcauccacgccacccacgaguggaugaccaccgaggacaugcugaccguguggaacagaguguggauccaggagaaccccuggauggaggacaagacccccguggagagcugggaggagauccccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 17530 - RNA, 9876 nt, Artificial Sequence
  derived and/or modified CDS sequence (opt4) from DENV-2__KT187554__SS-prME
accgccggcaucaucaucaugaugauccccaccgugauggccuuccaccugaccaccagaaacggcgagccccacaugaucgugagcagacaggagaagggcaagagccugcuguucaagaccgagaacggcgugaacaugugcacccugauggccauggaccugggcgagcugugcgaggacaccaucaccuacaacugcccccugcugagacagaacgagcccgaggacaucgacugcuggugcaacagcaccagcaccugggugaccuacggcaccugcaccgccaccggcgagcacagaagagagaagagaagcguggcccuggugccccacgugggcaugggccuggagaccagaaccgagaccuggaugagcagcgagggcgccuggaagcacgcccagagaaucgagaccugggugcugagacaccccggcuucaccaucauggccgccauccuggccuacaccaucggcaccaccuacuuccagagagugcugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcaccccgccacccugagaaaguacugcaucgaggccaagcugaccaacaccaccaccgccagcagaugccccacccagggcgagcccagccugaacgaggagcaggacaagagauucgugugcaagcacagcaugguggacagaggcuggggcaacggcugcggccuguucggcaagggcggcaucgugaccugcgccauguucaccugcaagaagaacauggagggcaagaucgugcagcccgagaaccuggaguacaccaucgugaucaccccccacagcggcgaggagaacgccgugggcaacgacaccggcaagcacggcaaggagaucaaggugaccccccagagcagcaucaccgaggccgagcugaccggcuacggcaccgugaccauggagugcagccccagaaccggccuggacuucaacgagauggugcugcugcagauggagaacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucgugaucagagugcaguacgagggcgacggcagccccugcaagauccccuucgagaucauggaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugagcugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcguggugaucaccuggaucggcaugaacagcagaagcaccagccugagcgugagccuggugcuggugggcguggugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagcugcacaaccacaccuuccugaucgacggccccgagaccgccgagugccccaacaccaacagagccuggaacagccuggagguggaggacuacggcuucggcguguucaccaccaacaucuggcugaagcugaaggagagacaggacguguucugcgacagcaagcugaugagcgccgccaucaaggacaacagagccgugcacgccgacaugggcuacuggaucgagagcgcccugaacgacaccuggaagaucgagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcagacuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugguggccgugagcuucgugacccugaucaccggcaacaugagcuucagagaccugggcagagugauggugauggugggcgccgccaugaccgacgacaucggcaugggcgugaccuaccuggcccugcuggccgccuucaaggugagacccaccuucgccgccggccugcugcugagaaagcugaccagcaaggagcugaugaugaccaccaucggcaucgugcugcugagccagagcaccaugcccgagaccauccuggagcugaccgacgcccuggcccugggcaugauggugcugaagaucgugagaaacauggagaaguaccagcuggccgugaccaucauggccauccugugcgugcccaacgccgugauccugcagaacgccuggaaggugagcugcaccacccuggccguggugagcgugagcccccuguuccugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugagaugggaggagcaggccgagaucagcggcagcagccccauccugagcaucaccaucagcgaggacggcagcaugagcaucaagaacgaggaggaggagcagacccugaccauccugaucagaaccggccugcuggugaucagcggccuguuccccgugagcauccccaucaccgccgccgccugguaccugugggaggugaagaagcagagagccggcgugcugugggacgugcccagccccccccccgugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacaagggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucguggacaagaagggcaagguggugggccuguacggcaacggcguggugaccagaagcggcaccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccaucagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacaucaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagagugggcagaaaccccaagaacgagaacgaccaguacaucuacaugggcgagccccuggagaacgacgaggacugcgcccacuggaaggaggccaagaugcugcuggacaacaucagcacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacagaguggccgccgagggcaucaacuacgccgacagaagauggugcuucgacggcgugaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagaaacgcccuggacaaccuggccgugcugcacaccgccgaggccggcggcagagccuacaaccacgcccugagcgagcugcccgagacccuggagacccugcugcugcugacccugcuggccgccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggacuucggccugggcagcaccaccacccagcagcccgagagcaacauccuggacaucgaccugagacccgccagcgccuggacccuguacgccguggccaccaccuucaucacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggaccccauccccuacgaccccaaguucgagaagcagcugggccaggugaugcugcuggugcugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccgccaacaccagaagaggcaccggcaacaccggcgagacccugggcgagaaguggaagaacagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaaccuggugacccccgagggcaaggugguggaccugggcugcggcagaggcggcuggagcuacuacugcggcggccugaagaacgugaaggaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccguggaggccggcagaacccugagagugcugaaccugguggagaacuggcugaacaacaacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccagcggcaacaucgugagcagcgugaacaugaucagcagaaugcugaucaacagauucaccaugagacacaagaaggccaccuacgagcccgacguggaccugggcagcggcaccagaaacaucggcaucgagagcgagacccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacgugauccccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcggcuucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagacgugagcaagagagagggcggcgccauguacgccgacgacaccgccggcugggacaccagaaucacccuggaggaccugaagaacgaggagauggugaccaaccacauggagggcgagcacaagaagcuggccgaggccaucuucaagcugaccuaccagaacaagguggugagagugcagagacccacccccagaggcaccgugauggacaucaucagcagaagagaccagagaggcagcggccagguggugaccuacggccugaacaccuucaccaacauggaggcccagcugaucagacagauggagggcgagggcguguucaagagcauccagcagcugaccgugaccgaggagaucgccgugaagaacuggcuggugagagugggcagagagagacugagcagaauggccaucagcggcgacgacugcguggugaagccccuggacgacagauucgccagcgcccugaccgcccugaacgacaugggcaaggugagaaaggacauccagcagugggagcccagcagaggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugagagagaccgccugccugggcaagagcuacgcccagauguggaaccugauguacuuccacagaagagaccugagacuggccgccaacgccaucugcagcgccgugcccagccacugggugcccaccagcagaaccaccuggagcauccacgccacccacgaguggaugaccaccgaggacaugcugaccguguggaacagaguguggauccaggagaaccccuggauggaggacaagacccccguggagagcugggaggagauccccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 17531 - RNA, 9876 nt, Artificial Sequence
  derived and/or modified CDS sequence (opt4) from DENV-2__KT187557__SS-prME
accgccggcaucaucaucaugaugauccccaccgugauggccuuccaccugaccaccagaaacggcgagccccacaugaucgugagcagacaggagaagggcaagagccugcuguucaagaccgagaacggcgugaacaugugcacccugauggccauggaccugggcgagcugugcgaggacaccaucaccuacaacugcccccugcugagacagaacgagcccgaggacaucgacugcuggugcaacagcaccagcaccugggugaccuacggcaccugcaccgccaccggcgagcacagaagagagaagagaagcguggcccuggugccccacgugggcaugggccuggagaccagaaccgagaccuggaugagcagcgagggcgccuggaagcacgcccagagaaucgagaccugggugcugagacaccccggcuucaccaucauggccgccauccuggccuacaccaucggcaccaccuacuuccagagagugcugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcaccccgccacccugagaaaguacugcaucgaggccaagcugaccaacaccaccaccgccagcagaugccccacccagggcgagcccagccugaacgaggagcaggacaagagauucgugugcaagcacagcaugguggacagaggcuggggcaacggcugcggccuguucggcaagggcggcaucgugaccugcgccauguucaccugcaagaagaacauggagggcaagaucgugcagcccgagaaccuggaguacaccaucgugaucaccccccacagcggcgaggagaacgccgugggcaacgacaccggcaagcacggcaaggagaucaaggugaccccccagagcagcaucaccgaggccgagcugaccggcuacggcaccgugaccauggagugcagccccagaaccggccuggacuucaacgagauggugcugcugcagauggagaacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucgugaucagagugcaguacgagggcgacggcagccccugcaagauccccuucgagaucauggaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugagcugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcguggugaucaccuggaucggcaugaacagcagaagcaccagccugagcgugagccuggugcuggugggcguggugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagcugcacaaccacaccuuccugaucgacggccccgagaccgccgagugccccaacaccaacagagccuggaacagccuggagguggaggacuacggcuucggcguguucaccaccaacaucuggcugaagcugaaggagagacaggacguguucugcgacagcaagcugaugagcgccgccaucaaggacaacagagccgugcacgccgacaugggcuacuggaucgagagcgcccugaacgacaccuggaagaucgagaaggccagcuucaucgaggugaagagcugccacuggcccaagagccacacccuguggagcaacggcgugcuggagagcgagaugaucauccccaagaacuucgccggccccaugagccagcacaacuacagacccggcuaccacacccagaccgccggccccuggcaccugggcagacuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugguggccgugagcuucgugacccugaucaccggcaacaugagcuucagagaccugggcagagugauggugauggugggcgccgccaugaccgacgacaucggcaugggcgugaccuaccuggcccugcuggccgccuucaaggugagacccaccuucgccgccggccugcugcugagaaagcugaccagcaaggagcugaugaugaccaccaucggcaucgugcugcugagccagagcaccaugcccgagaccauccuggagcugaccgacgcccuggcccugggcaugauggugcugaagaucgugagaaacauggagaaguaccagcuggccgugaccaucauggccauccugugcgugcccaacgccgugauccugcagaacgccuggaaggugagcugcaccacccuggccguggugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugagaugggaggagcaggccgagaucagcggcagcagccccauccugagcaucaccaucagcgaggacggcagcaugagcaucaagaacgaggaggaggagcagacccugaccauccugaucagaaccggccugcuggugaucagcggccuguuccccgugagcauccccaucaccgccgccgccugguaccugugggaggugaagaagcagagagccggcgugcugugggacgugcccagccccccccccgugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacaagggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucguggacaagaagggcaagguggugggccuguacggcaacggcguggugaccagaagcggcaccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccaucagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacaucaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagagugggcagaaaccccaagaacgagaacgaccaguacaucuacaugggcgagccccuggagaacgacgaggacugcgcccacuggaaggaggccaagaugcugcuggacaacaucagcacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacagaguggccgccgagggcaucaacuacgccgacagaagauggugcuucgacggcgugaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagaaacgcccuggacaaccuggccgugcugcacaccgccgaggccggcggcagagccuacaaccacgcccugagcgagcugcccgagacccuggagacccugcugcugcugacccugcuggccgccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggacuucggccugggcagcaccaccacccagcagcccgagagcaacauccuggacaucgaccugagacccgccagcgccuggacccuguacgccguggccaccaccuucaucacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggaccccauccccuacgaccccaaguucgagaagcagcugggccaggugaugcugcuggugcugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccgccaacaccagaagaggcaccggcaacaccggcgagacccugggcgagaaguggaagaacagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaaccuggugacccccgagggcaaggugguggaccugggcugcggcagaggcggcuggagcuacuacugcggcggccugaagaacgugaaggaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccguggaggccggcagaacccugagagugcugaaccugguggagaacuggcugaacaacaacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccagcggcaacaucgugagcagcgugaacaugaucagcagaaugcugaucaacagauucaccaugagacacaagaaggccaccuacgagcccgacguggaccugggcagcggcaccagaaacaucggcaucgagagcgagacccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacgugauccccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcggcuucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacauggagggcgagcacaagaagcuggccgaggccaucuucaagcugaccuaccagaacaagguggugagagugcagagacccacccccagaggcaccgugauggacaucaucagcagaagagaccagagaggcagcggccagguggugaccuacggccugaacaccuucaccaacauggaggcccagcugaucagacagauggagggcgagggcguguucaagagcauccagcagcugaccgugaccgaggagaucgccgugaagaacuggcuggugagagugggcagagagagacugagcagaauggccaucagcggcgacgacugcguggugaagccccuggacgacagauucgccagcgcccugaccgcccugaacgacaugggcaaggugagaaaggacauccagcagugggagcccagcagaggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugagagagaccgccugccugggcaagagcuacgcccagauguggaaccugauguacuuccacagaagagaccugagacuggccgccaacgccaucugcagcgccgugcccagccacugggugcccaccagcagaaccaccuggagcauccacgccacccacgaguggaugaccaccgaggacaugcugaccguguggaacagaguguggauccaggagaaccccuggauggaggacaagacccccguggagagcugggaggagauccccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 17532 - RNA, 9876 nt, Artificial Sequence
  derived and/or modified CDS sequence (opt4) from DENV-2__JQ045670__SS-prME
agcgccggcaugaucaucaugcugauccccaccgugauggccuuccaccugaccaccagaaacggcgagccccacaugaucgugggcauccaggagaagggcaagagccugcuguucaagaccgaggacggcgugaacaugugcacccugauggccauggaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgcccagagaaucgagaccuggauccugagacaccccggcuucaccaucauggccgccauccuggccuacaccaucggcaccacccacuuccagagagugcugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaaggaggagcaggacaagagauucgugugcaagcacagcaugguggacagaggcuggggcaacggcugcggccuguucggcaagggcggcaucgugaccugcgccauguucaccugcaagaagaacauggagggcaagaucgugcagcccgagaaccuggaguacaccaucguggugaccccccacagcggcgaggagcacgccgugggcaacgacaccggcaagcacggcaaggagaucaaggugaccccccagagcagcaucaccgaggccgagcugaccggcuacggcaccgugaccauggagugcagccccagaaccggccuggacuucaacgagauggugcugcugcagauggagaacaaggccuggcuggugcacagacagugguuccuggaccugccccugcccuggcugcccggcgccgacaagcaggagagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucgugaucagagugcaguacgagggcgacggcagccccugcaagauccccuucgagaucauggaccuggagaagagauacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcaucgugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccaggaggagggcaucugcggcaucagaagcgugaccagacuggagaaccugauguggaagcagaucacccccgagcugaaccacauccuggccgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagcuacaaccagaccuuccugaucgacggccccgagaccgccgagugccccaacaccaacagagccuggaacagccuggagguggaggacuacggcuucggcguguucaccaccaacaucuggcugaagcugaaggagaagcaggacgccuucugcgacagcaagcugaugagcgccgccaucaaggacaacagagccgugcacgccgacaugggcuacuggaucgagagcgcccugaacgacaccuggaagaucgagaaggccagcuucaucgaggugaagaacugccacuggcccaagagccacacccuguggagcaacggcgugcuggagagcgagaugaucauccccaagaaccuggccggccccgugagccagcacaacuacagacccggcuaccacacccagaucgccggccccuggcaccugggcaagcuggagauggacuucgacuucugcgacggcaccaccgugaucgugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagguggacaacuucagccugggcgugcugggcauggcccuguuccuggaggagaugcugagaaccagagugggcaccaagcacgccauccugcugguggccgugagcuucgugacccugaucaccggcaacaugagcuucaaggaccugggcagagugguggugauggugggcgccgccauggccgacgacaucggcaugggcgugaccuaccuggcccugcuggccgccuucaaggugagacccaccuucgccgccggccugcugcugagaaagcugaccagcaaggagcugaugaugaccaccaucggcaucgugcugcugagccagagcaccauccccgagaccgugcuggagcugaccgacgcccuggcccugggcaugauggugcugaagaucgugagaaacauggagaaguaccagcuggccgugaccaucauggccauccugugcgugcccaacgccgugauccugcagaacgccuggaaggugagcugcaccauccuggccguggugagcgugagcccccugcugcugaccagcagccagcagaagaccgacuggaucccccuggcccugaccaucaagggccugaaccccaccgccaucuuccugaccacccugagcagaaccaacaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccaccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggccuguuccccaucagcauccccaucaccgccgccgccugguaccugugggaggugaagaagcagagagccggcgugcugugggacgugcccagccccccccccaugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacaagggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucaucgacaagaagggcaagguggugggccuguacggcaacggcguggugaccagaagcggcgccuacgugagcgccaucgcccagaccgagaagagcaucgaggacaaccccgagaucgaggacgacaucuucagaaagagaagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaagauggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaagaccagagacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcagaggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggacuucggccugggcagcaucgccacccagcagcccgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggaccccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaccuacaagaagagcggcauccaggagguggacagaacccuggccaaggagggcaucaagagaggcgagaccgaccaccacgccgugagcagaggcagcgccaagcugagaugguucguggagagaaaccuggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaucccccccgagaagugcgacacccugcugugcgacaucggcgagagcagccccaaccccaccguggaggccggcagaacccugagagugcugaaccugguggagaacuggcugaacaacaacacccaguucugcaucaaggugcugaaccccuacaugcccagcgugaucgagaagauggaggcccugcagagaaaguacggcggcgcccuggugagaaacgaccugagcagaaacagcacccacgagauguacugggugagcaacgccagcggcaacaucgugagcagcgugaacaugaucagcagaaugcugaucaacagauucaccaugagacacaagaaggccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacgugcugcccaccgugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcagauucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacauggagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcguguucaagaacauccagcaccugaccgugaccgaggagguggccgugcagaacuggcuggccagagugggcagagagagacugagcagaauggccaucagcggcgacgacugcguggugaagccccuggacgacagauucgccaacgcccugaccgcccugaacgacaugggcaagaucagaaaggacauccagcagugggagcccagcaagggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugagagagaccgccugccugggcaagagcuacgcccagauguggagccugauguacuuccacagaagagaccugagacuggccgccaacgccaucugcagcgccgugcccagccacugggugcccaccagcagaaccaccuggagcauccacgccaagcacgaguggaugaccaccgaggacaugcugaccguguggaacagaguguggaucagagagaaccccuggauggaggacaagacccccguggagagcugggaggagauccccuaccugggcaagagagaggaccaguggugcggcagccugaucggccugaccagcagagccaccugggccaagaacauccaggccgccaucaaccaggugagaagccugaucggcaacgaggaguacaccgacuacaugcccagcaugaagagauucagaagagaggaggaggaggccggcgugcugugguga

SEQ ID NO: 17533 - RNA, 9876 nt, Artificial Sequence
  derived and/or modified CDS sequence (opt4) from DENV-2__JQ045686__SS-prME
agcgccggcaugaucaucaugcugauccccaccgugauggccuuccaccugaccaccagaaacggcgagccccacaugaucgugggcauccaggagaagggcaagagccugcuguucaagaccgaggacggcgugaacaugugcacccugauggccauggaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgcccagagaaucgagaccuggauccugagacaccccggcuucaccaucauggccgugauccuggccuacaccaucggcaccacccacuuccagagagugcugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaaggaggagcaggacaagagauucgugugcaagcacagcaugguggacagaggcuggggcaacggcugcggccuguucggcaagggcggcaucgugaccugcgccauguucaccugcaagaagaacauggagggcaagaucgugcagcccgagaaccuggaguacaccaucguggugaccccccacagcggcgaggagcacgccgugggcaacgacaccggcaagcacggccaggagaucaaggugaccccccagagcagcaucaccgaggccgagcugaccggcuacggcaccgugaccauggagugcagccccagaaccggccuggacuucaacgagauggugcugcugcagauggagaacaaggccuggcuggugcacagacagugguuccuggaccugccccugcccuggcugcccggcgccgacaagcaggagagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucgugaucagagugcaguacgagggcgacggcagccccugcaagauccccuucgagaucauggaccuggagaagagauacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcaucgugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccaggaggagggcaucugcggcaucagaagcgugaccagacuggagaaccugauguggaagcagaucacccccgagcugaaccacauccuggccgagaacgaggugaagcugaccaucaucaccggcgacaucaagggcaucaugcaggccggcaagagaagccugagaccccagcccaccgagcugaaguacagcuggaagaccuggggcaaggccaagaugcugagcaccgagagcuacaaccagaccuuccugaucgacggccccgagaccgccgagugccccaacaccaacagagccuggaacagccuggagguggaggacuacggcuucggcguguucaccaccaacaucuggcugaagcugaaggagaagcaggacgccuucugcgacagcaagcugaugagcgccgccaucaaggacaacagagccgugcacgccgacaugggcuacuggaucgagagcgcccugaacgacaccuggaagaucgagaaggccagcuucaucgaggugaagaacugccacuggcccaagagccacacccuguggagcaacggcgugcuggagagcgagaugaucauccccaagaaccuggccggccccgugagccagcacaacuacagacccggcuaccacacccagaucgccggccccuggcaccugggcaagcuggagauggacuucaacuucugcgacggcaccaccgugaucgugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagguggacaacuucagccugggcgugcugggcauggcccuguuccuggaggagaugcugagaaccagagugggcaccaagcacgccauccugcugguggccgugagcuucgugacccugaucaccggcaacaugagcuucaaggaccugggcagagugguggugauggugggcgccaccaugaccgacgacaucggcaugggcgugaccuaccuggcccugcuggccgccuucaaggugagacccaccuucgccgccggccugcugcugagaaagcugaccagcaaggagcugaugaugaccaccaucggcaucgugcugcugagccagagcaccauccccgagaccgugcuggagcugaccgacgcccuggcccugggcaugauggugcugaagaucgugagaaacauggagaaguaccagcuggccgugaccaucauggccauccugugcgugcccaacgccgugauccugcagaacgccuggaaggugagcugcaccauccuggccguggugagcgugagcccccugcugcugaccagcagccagcagaagaccgacuggaucccccuggcccugaccaucaagggccugaaccccaccgccaucuuccugaccacccugagcagaaccaacaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccaccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggccuguuccccaucagcauccccaucaccgccgccgccugguaccugugggaggugaagaagcagagagccggcgugcugugggacgugcccagccccccccccaugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacaagggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucaucgacaagaagggcaagguggugggccuguacggcaacggcguggugaccagaagcggcgccuacgugagcgccaucgcccagaccgagaagagcaucgaggacaaccccgagaucgaggacgacaucuucagaaagagaagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucaucgacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgugggcgaguacagacugagaggcgaggccagaaagaccuucguggaccugaugagaagaggcgaccugcccguguggcuggccuacaagguggccgccgagggcaucaacuacgccgacagaagauggugcuucgacggcaucaagaacaaccagauccuggaggagaacauggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaagaccagagacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcagaggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucgccacccagcagcccgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggaccccauccccuacgaccccaaguucgagaagcagcugggccaggugaugcugcuggugcugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaugggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaucccccccgagaagugcgacacccugcugugcgacaucggcgagagcagccccaaccccaccguggaggccggcagaacccugagagugcugaaccugguggagaacuggcugaacaacaacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccagcggcaacaucgugagcagcgugaacaugaucagcagaaugcugaucaacagauucaccaugagacacaagaaggccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacgugcugcccaccgugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcagauucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagacgugagcaagaaggagggcggcgccauguacgccgacgacaccgccggcugggacaccagagugacccuggaggaccugaagaacgaggagauggugaccaaccacauggagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcguguucaagaacauccagcaccugaccgugaccgaggagguggccgugaagaacuggcuggccagagugggcagagagagacugagcagaauggccaucagcggcgacgacugcguggugaagccccuggacgacagauucgccaacgcccugaccgcccugaacgacaugggcaagaucagaaaggacauccagcagugggagcccagcagaggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugagagagaccgccugccugggcaagagcuacgcccagauguggagccugauguacuuccacagaagagaccugagacuggccgccaacgccaucugcagcgccgugcccagccacugggugcccaccagcagaaccaccuggagcauccacgccaagcacgaguggaugaccaccgaggacaugcugaccguguggaacagaguguggaucagagagaaccccuggauggaggacaagacccccguggagagcugggaggagauccccuaccugggcaagagagaggaccaguggugcggcagccugaucggccugaccagcagagccaccugggccaagaacauccaggccgccaucaaccaggugagaagccugaucggcaacgaggaguacaccgacuacaugcccagcaugaagagauucagaagagaggaggaggaggccggcgugcugugguga

SEQ ID NO: 17534 - RNA, 9876 nt, Artificial Sequence
  derived and/or modified CDS sequence (opt4) from DENV-2__KU094070__SS-prME
accgccggcaugaucaucaugcugauccccaccgugauggccuuccaccugaccaccagaaacggcgagccccacaugaucgugagcagacaggagaagggcaagagccugcuguucaagaccgaggacggcgugaacaugugcacccugauggccauggaccugggcgaguggcuggaggacaagaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgcccagagaaucgagaccuggauccugagacaccccggcuucaccaucauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaacgaggagcaggacaagagauucgugugcaagcacagcaugguggacagaggcuggggcaacggcugcggccuguucggcaagggcagcaucgugaccugcgccauguucaccugcaagaagaucaugaagggcaagguggugcagcccgagaaccuggaguacaccaucgugaucaccccccacagcggcgaggagcacgccgugggcaacgacaccggcaagcacggcaaggagaucaagaucaccccccagagcagcaucaccgaggccgagcugaccggcuacggcaccgugaccauggagugcagccccagaaccggccuggacuucaacgagauggugcugcugcagauggagaacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcuaccugcuguucaccggccaccugaagugcagacugagaauggacaagcugcagcugaagggcaugagcuacagcaugugcaccggcaaguucaagguggugaaggagaucgccgagacccagcacggcaccaucgugaucagagugcaguacgagggcgacggcagccccugcaagauccccuucgagaucauggaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaccggcgugaucaucaccuggaucggcaugaacagcagaagcaccagccugagcgugagccuggugcuggugggcgccgugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucaccaccaacaucuggcugaagcugagagaggagcaggacguguucugcgacagcaagcugaugagcgccgccaucaaggacaacagagccgugcacgccgacaugggcuacuggaucgagagcgcccugaacgacaccuggaagaucgagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcaagcuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugaugaccaccaucggcaucgugcugcugagccagagcaccauccccgagaccauccuggagcugaccgacgcccuggcccugggcaugauggugcugaagauggugagaaagauggagaaguaccagcuggccgugaccaucauggccauccugugcgugcccaacgccgugauccugcagaacgccuggaaggugagcugcaccauccuggccguggugagcgugagcccccuguuccugaccagcagccagcagaaggccgacuggaucccccuggcccugaccaucaagggccugaaccccaccgccaucuuccugaccacccugagcagaaccaacaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggccuguuccccgugagcauccccaucaccgccgccgccugguaccugugggaggugaagaagcagagagccggcgugcugugggacgugcccagccccccccccgugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacaagggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacgccggcaccaucggcgccgugagccuggacuucagccccggcaccagcggcagccccaucaucgacaagaagggcaagguggugggccuguacggcaacggcguggugaccagaagcggcgccuacgugagcgccaucgcccagaccgagaagagcaucgaggacaaccccgagaucgaggacgacaucuucagaaagagaaagcugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggagcagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagaaccaacgacugggacuucguggugaccaccgacaucagcgagaugggcgccaacuucaaggccgagagagugaucgaccccagaagaugcaugaagcccgugauccugaccgacggcgaggagagagugacccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacagaguggccgccgagggcaucaacuacgccgacagaagauggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagagacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcagaggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucaccacccagcagcccgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccuguuccugcugguggcccacuacgccaucaucggccccggccugcaggccaaggccaccagagaggcccagaagagagccgccgccggcaucaugaagaaccccaccguggacggcaucaccgugaucgaccuggaccccauccccuacgaccccaaguucgagaagcagcugggccaggugaugcugcuggugcugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaaccuggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccguggaggccggcagaacccugagagugcugaaccugguggagaacuggcugaacaacaacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccagcggcaacaucgugagcagcgugaacaugaucagcagaaugcugaucaacagauucaccaugagacacaagaaggccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacguggugcccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcagauucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacauggagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcguguucaagagcauccagcaccugaccgugaccgaggagaucgccgugcagaacuggcuggccagagugggcagagagagacugagcagaauggccaucagcggcgacgacugcguggugaagccccuggacgacagauucgccagcgcccugaccgcccugaacgacaugggcaaggugagaaaggacauccagcagugggagcccagcagaggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugagagagaccgccugccugggcaagagcuacgcccagauguggagccugauguacuuccacagaagagaccugagacuggccgccaacgccaucugcagcgccgugcccagccacugggugcccaccagcagaaccaccuggagcauccacgccaagcacgaguggaugaccaccgaggacaugcugaccguguggaacagaguguggauccaggagaaccccuggauggaggacaagacccccguggagagcugggaggagauccccuaccugggcaagagagaggaccaguggugcggcagccugaucggccugaccagcagagugaccuggggcaagaacauccagaccgccaucaaccaggugagaagccugaucggcaacgaggaguacaccgacuacaugcccagcaugaagagauucagaagagaggaggaggaggccggcgugcugugguga

SEQ ID NO: 17535 - RNA, 9876 nt, Artificial Sequence
  derived and/or modified CDS sequence (opt4) from DENV-2__FM210215__SS-prME
agcgccggcaugaucgugaugcugauccccaccgugauggccuuccaccugaccaccagaaacggcgagccccacaugaucgugggcauccaggagaagggcaagagccugcuguucaagaccgaggacggcgugaacaugugcacccugauggccauggaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgcccagagaaucgagaccuggauccugagacaccccggcuucaccaucauggccgccauccuggccuacaccaucggcaccacccacuuccagagagugcugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaaggaggagcaggacaagagauucgugugcaagcacagcaugguggacagaggcuggggcaacggcugcggccuguucggcaagggcggcaucgugaccugcgccauguucaccugcaagaagaacauggagggcaagaucgugcagcccgagaaccuggaguacaccaucguggugaccccccacagcggcgaggagcacgccgugggcaacgacaccggcaagcacggcaaggagaucaaggugaccccccagagcagcaucaccgaggccgagcugaccggcuacggcaccgugaccauggagugcagccccagaaccggccuggacuucaacgagauggugcugcugcagauggagaacaaggccuggcuggugcacagacagugguuccuggaccugccccugcccuggcugcccggcgccgacaagcaggagagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucgugaucagagugcaguacgagggcgacggcagccccugcaagauccccuucgagaucauggaccuggagaagagauacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcaucgugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccaggaggagggcaucugcggcaucagaagcgugaccagacuggagaaccugauguggaagcagaucacccccgagcugaaccacauccuggccgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagcuacaaccagaccuuccugaucgacggccccgagaccgccgagugccccaacaccaacagagccuggaacagccuggagguggaggacuacggcuucggcguguucaccaccaacaucuggcugaagcugaaggagaagcaggacgccuucugcgacagcaagcugaugagcgccgccaucaaggacaacagagccgugcacgccgacaugggcuacuggaucgagagcgcccugaacgacaccuggaagaucgagaaggccagcuucaucgaggugaagaacugccacuggcccaagagccacacccuguggagcaacggcgugcuggagagcgagaugaucauccccaagaaccuggccggccccgugagccagcacaacuacagacccggcuaccacacccagaucgccggccccuggcaccugggcaagcuggagauggacuucgacuucugcgacggcaccaccgugaucgugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagguggacaacuucagccugggcgugcugggcauggcccuguuccuggaggagaugcugagaaccagagugggcaccaagcacgccauccugcugguggccgugagcuucgugacccugaucaccggcaacaugagcuucaaggaccugggcagagugguggugauggugggcgccaccauggccgacgacaucggcaugggcgugaccuaccuggcccugcuggccgccuucaaggugagacccaccuucgccgccggccugcugcugagaaagcugaccagcaaggagcugaugaugaccaccaucggcaucgugcugcugagccagagcaccauccccgagaccgugcuggagcugaccgacgcccuggcccugggcaugauggugcugaagaucgugagaaacauggagaaguaccagcuggccgugaccaucauggccauccugugcgugcccaacgccguggugcugcagaacgccuggaaggugagcugcaccauccuggccguggugagcgugagcccccugcugcugaccagcagccagcagaagaccgacuggaucccccuggcccugaccaucaagggccugaaccccaccgccaucuuccugaccacccugagcagaaccaacaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagaaggccaccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggccuguuccccaucagcauccccaucaccgccgccgccugguaccugugggaggugaagaagcagagagccggcgugcugugggacgugcccagccccccccccaugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacaagggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucaucgacaagaagggcaagguggugggccuguacggcaacggcguggugaccagaagcggcgccuacgugagcgccaucgcccagaccgagaagagcaucgaggacaaccccgagaucgaggacgacaucuucagaaagagaagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucaaggccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucaucgacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaagauggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaagaccagagacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcagaggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucgccacccagcagcccgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggaccccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacagccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagagcgugagagaggugaagggccugaccaagggcggccccggccacgaggagcccauccccaugagcaccuacggcuggaaccuggugagacugcagagcggcguggacguguucuucaucccccccgagaagugcgacacccugcugugcgacaucggcgagagcagccccaaccccaccguggaggccggcagaacccugagagugcugaaccugguggagaacuggcugaacaacaacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccagcggcaacaucgugagcagcgugaacaugaucagcagaaugcugaucaacagauucaccaugagacacaagaaggccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacgugcugcccaccgugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcagauucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacauggagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcguguucaagaacauccagcaccugaccgugaccgaggagguggccgugcagaacuggcuggccagagugggcagagagagacugagcagaauggccaucagcggcgacgacugcguggugaagccccuggacgacagauucgccaacgcccugaccgcccugaacgacaugggcaagaucagaaaggacauccagcagugggagcccagcaagggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugagagagaccgccugccugggcaagagcuacgcccagauguggagccugauguacuuccacagaagagaccugagacuggccgccaacgccaucugcagcgccgugcccagccacugggugcccaccagcagaaccaccuggagcauccacgccaagcacgaguggaugaccaccgaggacaugcugaccguguggaacagaguguggaucagagagaaccccuggauggaggacaagacccccguggagagcugggaggagauccccuaccugggcaagagagaggaccaguggugcggcagccugaucggccugaccagcagagccaccugggccaagaacauccaggccgccaucaaccaggugagaagccugaucggcaacgaggaguacaccgacuacaugcccagcaugaagagauucagaagagaggaggaggaggccggcgugcugugguga

SEQ ID NO: 17536 - RNA, 9876 nt, Artificial Sequence
  derived and/or modified CDS sequence (opt4) from DENV-2__FM210216__SS-prME
agcgccggcaugaucaucaugcugauccccaccgugauggccuuccaccugaccaccagaaacggcgagccccacaugaucgugggcauccaggagaagggcaagagccugcuguucaagaccgaggacggcgugaacaugugcacccugauggccauggaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgcccagagaaucgagaccuggauccugagacaccccggcuucaccaucauggccgccauccuggccuacaccaucggcaccacccacuuccagagagugcugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaaggaggagcaggacaagagauucgugugcaagcacagcaugguggacagaggcuggggcaacggcugcggccuguucggcaagggcggcaucgugaccugcgccauguucaccugcaagaagaacauggagggcaagaucgugcagcccgagaaccuggaguacaccaucguggugaccccccacagcggcgaggagcacgccgugggcaacgacaccggcaagcacggcaaggagaucaaggugaccccccagagcagcaucaccgaggccgagcugaccggcuacggcaccgugaccauggagugcagccccagaaccggccuggacuucaacgagauggugcugcugcagauggagaacaaggccuggcuggugcacagacagugguuccuggaccugccccugcccuggcugcccggcgccgacaagcaggagagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucgugaucagagugcaguacgagggcgacggcagccccugcaagauccccuucgagaucauggaccuggagaagagauacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcaucgugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccaggaggagggcaucugcggcaucagaagcgugaccagacuggagaaccugauguggaagcagaucacccccgagcugaaccacauccuggccgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagcuacaaccagaccuuccugaucgacggccccgagaccaccgagugccccaacaccaacagagccuggaacagccuggagguggaggacuacggcuucggcguguucaccaccaacaucuggcugaagcugaaggagaagcaggacgccuucugcgacagcaagcugaugagcgccgccaucaaggacaacagagccgugcacgccgacaugggcuacuggaucgagagcgcccugaacgacaccuggaagaucgagaaggccagcuucaucgaggugaagaacugccacuggcccaagagccacacccuguggagcaacggcgugcuggagagcgagaugaucauccccaagaaccuggccggccccgugagccagcacaacuacagacccggcuaccacacccagaucgccggccccuggcaccugggcaagcuggagauggacuucgacuucugcgacggcaccaccgugaucgugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagguggacaacuucagccugggcgugcugggcauggcccuguuccuggaggagaugcugagaaccagagugggcaccaagcacgccauccugcugguggccgugagcuucgugacccugaucaccggcaacaugagcuucaaggaccugggcagagugguggugauggugggcgccaccauggccgacgacaucggcaugggcgugaccuaccuggcccugcuggccgccuucaaggugagacccaccuucgccgccggccugcugcugagaaagcugaccagcaaggagcugaugaugaccaccaucggcaucgugcugcugagccagagcaccauccccgagaccgugcuggagcugaccgacgcccuggcccugggcaugauggugcugaagaucgugagaaacauggagaaguaccagcuggccgugaccaucauggccauccugugcgugcccaacgccgugauccugcagaacgccuggaaggugagcugcaccauccuggccguggugagcgugagcccccugcugcugaccagcagccagcagaagaccgacuggaucccccuggcccugaccaucaagggccugaaccccaccgccaucuuccugaccacccugagcagaaccaacaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccaccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggccuguuccccaucagcauccccaucaccgccgccgccugguaccugugggaggugaagaagcagagagccggcgugcugugggacgugcccagccccccccccaugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacaagggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucaucgacaagaagggcaagguggugggccuguacggcaacggcguggugaccagaagcggcgccuacgugagcgccaucgcccagaccgagaagagcaucgaggacaaccccgagaucgaggacgacaucuucagaaagagaagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucaucgacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaagauggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaagaccagagacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcagaggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucgccacccagcagcccgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggaccccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaucccccccgagaagugcgacacccugcugugcgacaucggcgagagcagccccaaccccaccguggaggccggcagaacccugagagugcugaaccugguggagaacuggcugaacaacaacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccagcggcaacaucgugagcagcgugaacaugaucagcagaaugcugaucaacagauucaccaugagacacaagaaggccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacgugcugcccaccgugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcagauucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacauggagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcguguucaagaacauccagcaccugaccgugaccgaggagguggccgugcagaacuggcuggccagagugggcagagagagacugagcagaauggccaucagcggcgacgacugcguggugaagccccuggacgacagauucgccaacgcccugaccgcccugaacgacaugggcaagaucagaaaggacauccagcagugggagcccagcaagggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugagagagaccgccugccugggcaagagcuacgcccagauguggagccugauguacuuccacagaagagaccugagacuggccgccaacgccaucugcagcgccgugcccagccacugggugcccaccagcagaaccaccuggagcauccacgccaagcacgaguggaugaccaccgaggacaugcugaccguguggaacagaguguggaucagagagaaccccuggauggaggacaagacccccguggagagcugggaggagauccccuaccugggcaagagagaggaccaguggugcggcagccugaucggccugaccagcagagccaccugggccaagaacauccaggccgccaucaaccaggugagaagccugaucggcaacgaggaguacaccgacuacaugcccagcaugaagagauucagaagagaggaggaggaggccggcgugcugugguga

SEQ ID NO: 17537 - RNA, 9876 nt, Artificial Sequence
  derived and/or modified CDS sequence (opt4) from DENV-2__FM210217__SS-prME
accgccggcgugaucaucaugcugauccccaccgccauggccuuccaccugaccaccagaaacggcgagccccacaugaucgugggcagacaggagaagggcaagagccugcuguucaagaccgaggacggcgugaacaugugcacccugauggccaucgaccugggcgagcugugcgaggacaccaucaccuacaagugcccccugcugagacagaacgagcccgaggacaucgacugcuggugcaacagcaccagcaccugggugaccuacggcaccugcaccaccaccggcgaccacagaagagagaagagaagcguggcccuggugccccacgugggcaugggccuggagaccagaaccgagaccuggaugagcagcgagggcgccuggaagcacgcccagagaaucgagaccuggauccugagacaccccggcuucaccaucauggccgccauccuggccuacaccgugggcaccacccacuuccagagagcccugaucuucauccugcuggccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaacgaggagcaggacaagagauucgugugcaagcacagcaugguggacagaggcuggggcaacggcugcggccuguucggcaagggcggcaucgugaccugcgccauguucaccugcaagaagaacauggagggcaagaucgugcagcccgagaaccuggaguacaccaucgugaucaccccccacagcggcgaggagcacgccgugggcaacgacaccggcaagcacggcaaggagaucaagaucaccccccagagccccaucaccgaggccgagcugaccggcuacggcaccgugaccauggagugcagccccagaaccggccuggacuucaacgagauggugcugcugcagauggaggacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagaucgugaaggagaucgccgagacccagcacggcaccaucgugaucagagugcaguacgagggcgacggcagccccugcaagauccccuucgagaucauggaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcgugaucacccuguaccugggcgccauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucaccaccaacaucuggcugaagcugagagagaagcaggacguguucugcgacagcaagcugaugagcgccgccaucaaggacaacagagccgugcacgccgacaugggcuacuggaucgagagcgcccugaacgacaccuggaagauggagaaggccagcuucaucgaggugaagagcugccacuggcccaagagccacacccuguggagcaacggcgugcuggagagcgagaugaucauccccaagagcuucgccggccccgugagccagcacaacuacagacccggcuacuacacccagaccgccggccccuggcaccugggcaagcuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugguggccgugagcuucgugacccugaucaccggcaacaugagcuucagagaccugggcagagugauggugauggugggcgccgccaugaccgacgacaucggcaucggcgugaccuaccuggcccugcuggccgccuucaaggugagacccaccuucgccgccggccugcugcugagaaagcugaccagcaaggagcugaugauggccaccaucggcaucgcccugcugagccagagcaccauccccgagaccauccuggagcugaccgacgcccuggcccugggcaugauggugcugaagaucgugagaaacauggagaaguaccagcuggccgugaccaucauggccaucagcugcgugcccaacgccgugauccugcagaacgccuggaaggugagcugcaccauccuggccaccgugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccaccgacgugaagugggaggaccaggccgagaucagcggcagcagccccauccugagcaucaccaucgccgaggacggcagcaugagcaucaagaacgaggaggaggagcagacccugaccauccugaucagaaccggccugcuggugaucagcggccuguuccccgugagcauccccaucaccgccgccgccugguaccugugggaggugaagaagcagagagccggcgugcugugggacgugcccagccccccccccgugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacagaggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucguggacagaaagggcaagguggugggccuguacggcaacggcguggugaccagaagcggcgccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcaaggaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacagaguggccgccgagggcaucaacuacgccgacagaagauggugcuucgacggcgugaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagagacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcgugggcaagaugacccugggcaugugcugcaucaucaccgccagcauccugcuguggcacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucgccacccaggagcccgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggaccccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccaucgaggccggcagaacccugagagugcugagccugguggagaacuggcugaacaacgacacccaguucugcaucaaggugcugaaccccuacaugcccagcgugaucgagaagauggagacccugcagagaaaguacggcggcgcccuggugagaaacccccugagcagaaacagcacccacgagauguacugggugagcaacgccaccggcaacaucgugagcagcgugaacaugaucagcagaaugcugaucaacagauucaccaugaagcacaagaaggccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacguggugcccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcagauucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacauggagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcaucuucaagagcauccagcaccugaccgccaccgaggagaucgccgugcagaacuggcuggccagagugggcagagagagacugagcagaauggccaucagcggcgacgacugcguggugaagccccuggacgacagauucgccagcgcccugaccgcccugaacgacaugggcaaggugagaaaggacauccagcagugggagcccagcagaggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugaaggagaccgccugccugggcaagagcuacgcccagauguggagccugauguacuuccacagaagagaccugagacuggccgccaacgccaucugcagcgccgugcccagccacugggugcccaccagcagaaccaccuggagcauccacgccaagcacgaguggaugaccaccgaggacaugcugaccguguggaacagaguguggauccaggagaaccccuggauggaggacaagacccccguggagagcugggaggaggugcccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 17538 - RNA, 9876 nt, Artificial Sequence
  derived and/or modified CDS sequence (opt4) from DENV-2__JX286524__SS-prME
accgccggcgugaucgugaugcugauccccaccgccauggccuuccaccugaccaccagaaacggcgagccccacaugaucgugggcagacaggagaagggcaagagccugcuguucaagaccgaggacggcgugaacaugugcacccugauggccaucgaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgugcagagaaucgagaccuggauccugagacaccccggcuucaccaucauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaacgaggagcaggacaagagauucaucugcaagcacagcaugguggacagaggcuggggcaacggcugcggccuguucggcaagggcggcaucgugaccugcgccauguucaccugcaagaagaacauggagggcaagaucgugcagcccgagaaccuggaguacaccaucgugaucaccccccacagcggcgaggagcacgccgugggcaacgacaccggcaagcacggcaaggagaucaagaucaccccccagagcagcaccaccgaggccgagcugaccggcuacggcaccgugaccauggagugcagccccagaaccggccuggacuucaacgagauggugcugcugcagauggaggacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagaucgugaaggagaucgccgagacccagcacggcaccaucgugaucagagugcaguacgagggcgacggcagccccugcaagauccccuucgagaucaccgaccuggagaagagacacgugcugggcagacugaucaccgugaaccccaucgugaccgagaaggacagccccgugaacaucgaggccgagccccccuucggcgacagcuacaucaucgugggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcguggugacccuguaccugggcgccauggugcaggccgacagcggcugcaucgugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucaccaccaacaucuggcugaagcugagagagaagcaggacguguucugcgacagcaagcugaugagcgccgccaucaaggacaacagagccgugcacgccgacaugggcuacuggaucgagagcgcccugaacgacaccuggaagauggagaaggccagcuucaucgaggugaagagcugccacuggcccaagagccacacccuguggagcaacggcgugcuggagagcgagaugaucauccccaagagcuucgccggccccgugagccagcacaacuacagacccggcuaccacacccagaccgccggccccuggcaccugggcaagcuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugguggcccugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugauggccaccaucggcaucgcccugcugagccagagcacccugcccgagaccauccuggagcugaccgacgcccuggcccugggcaugauggcccugaagaucgugagaaacauggagaaguaccagcuggccgugaccaucauggccaucagcugcgugcccaacgccgugauccugcagaacgccuggaaggugagcugcaccauccuggccgccgugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggcguguuccccgugagcauccccaucaccgccgccgccugguaccugugggaggugaagaagcagagagccggcgugcugugggacgugcccagccccccccccgugggcaaggccgagcuggaggacggcgccuacagaaucaagcagagaggcauccugggcuacagccagaucggcgccggcguguacaaggagggcaccuuccacaccauguggcacgugaccagaggcgccgugcugaugcacagaggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggcaucuucaagaccaacaccggcaccaucggcgccgugagccuggacuucagccccggcaccagcggcagccccaucguggacagaaagggcaagguggugggccuguacggcaacggcguggugaccagaagcggcgccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagagccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaaaguggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagaaacgcccuggacaaccuggccgugcugcacaccgccgaggugggcggcaaggccuacacccacgcccugagcgagcugcccgagacccuggagacccugcugcugcugacccugcuggccgccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggcuucggcagcaucaccacccaggagagcgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggagcccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacgugggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccaucgaggccggcagaacccugagagugcugaaccugguggagaacuggcugaacaacaacacccaguucugcaucaaggugcugaaccccuacaugcccagcgugaucgagaagauggagacccugcagagaaaguacggcggcgcccuggugagaaacccccugagcagaaacagcacccacgagauguacugggugagcaacgccaccggcaacaucgugagcagcgugaacaugaucagcagaaugcugaucaacagauucaccaugaagcacaagaaggccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacguggugcccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaaggagaagacccccagaaugugcaccagagaggaguucaccagaaaggugagaagcaacgccgcccugggcgccguguucaccgacgagaacaaguggaagagcgccagagaggccguggaggacggcagauucugggagcugguggacagagagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagaggcaacagccugagcggcguggagggcgagggccugcacagacugggcuacauccugagagaggugggcaagaaggagggcggcgccauguacgccgacgacaccgccggcugggacaccagaaucacccuggaggaccugaagaacgaggagauggugaccaaccacaugaagggcgagcacaagaagcuggccgaggccaucuucaagcugaccuaccagaacaagguggugagagugcagagacccacccccagaggcaccgugauggacaucaucagcagaaaggaccagagaggcagcggccaggugggcaccuacggccugaacaccuucaccaacauggaggcccagcugaucagacagauggagggcgagggcaucuucaagagcauccagcaccugaccgccaccgaggagaucgccgugcagaacuggcuggccagagugggcagagagagacugagcagaauggccaucagcggcgacgacugcguggugaagcccaucgacgacagauucgccagcgcccugaccgcccugaacgacaugggcaaggugagaaaggacauccagcagugggagcccagcagaggcuggaacgacuggacccaggugcccuucugcagccaccacuuccacgagcuggugaugaaggacggcagagugcugguggugcccugcagaaaccaggacgagcugaucggcagagccagaaucagccagggcgccggcuggagccugaaggagaccgccugccugggcaagagcuacgcccagauguggacccugauguacuuccacagaagagaccugagacuggccgccaacgccaucugcagcgccgugcccagccacugggugcccaccagcagaaccaccuggagcauccacgccaagcacgaguggaugaccaccgaggacaugcuggccguguggaacagaguguggauccaggagaaccccuggauggaggacaagacccccguggagagcugggaggaggugcccuaccugggcaagagagaggaccaguggugcggcagccugaucggccugaccagcagagccaccugggccaagaacauccagaccgccaucaaccaggugagaagccugaucggcaacgagggcuacaccgacuacaugcccagcaugaagagauucagaagagaggaggaggaggccggcgugcugugguga

SEQ ID NO: 17539 - RNA, 9876 nt, Artificial Sequence
  derived and/or modified CDS sequence (opt4) from DENV-2__JX286520__SS-prME
accgccggcgugaucgugaugcugauccccaccgccauggccuuccaccugaccaccagaaacggcgagccccacaugaucgugggcagacaggagaagggcaagagccugcuguucaagaccgaggacggcgugaacaugugcacccugauggccaucgaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgugcagagaaucgagaccuggauccugagacaccccggcuucaccaucauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaacgaggagcaggacaagagauucaucugcaagcacagcaugguggacagaggcuggggcaacggcugcggccuguucggcaagggcggcaucgugaccugcgccauguucaccugcaagaagaacauggagggcaagaucgugcagcccgagaaccuggaguacaccaucgugaucaccccccacagcggcgaggagcacgccgugggcaacgacaccggcaagcacggcaaggagaucaagaucaccccccagagcagcaccaccgaggccgagcugaccggcuacggcaucgugaccauggagugcagccccagaaccggccuggacuucaacgagauggugcugcugcagauggaggacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagaucgugaaggagaucgccgagacccagcacggcaccaucgugaucagagugcaguacgagggcgacggcagccccugcaagauccccuucgagaucaccgaccuggagaagagacacgugcugggcagacugaucaccgugaaccccaucgugaccgagaaggacagccccgugaacaucgaggccgagccccccuucggcgacagcuacaucaucgugggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcguggugacccuguaccugggcgccauggugcaggccgacagcggcugcaucgugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucaccaccaacaucuggcugaagcugagagagaagcaggacguguucugcgacagcaagcugaugagcgccgccaucaaggacaacagagccgugcacgccgacaugggcuacuggaucgagagcgcccugaacgacaccuggaagauggagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcaagcuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugguggcccugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugauggccaccaucggcaucgcccugcugagccagagcacccugcccgagaccauccuggagcugaccgacgcccuggcccugggcaugauggcccugaagaucgugagaaacauggagaaguaccagcuggccgugaccaucauggccaucagcugcgugcccaacgccgugauccugcagaacgccuggaaggugagcugcaccauccuggccgccgugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggcguguuccccgugagcauccccaucaccgccgccgccugguaccugugggaggugaagaagcagagagccggcgugcugugggacgugcccagccccccccccgugggcaaggccgagcuggaggacggcgccuacagaaucaagcagagaggcauccugggcuacagccagaucggcgccggcguguacaaggagggcaccuuccacaccauguggcacgugaccagaggcgccgugcugaugcacagaggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggcaucuucaagaccaacaccggcaccaucggcgccgugagccuggacuucagccccggcaccagcggcagccccaucguggacagaaagggcaagguggugggccuguacggcaacggcguggugaccagaagcggcgccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagagccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaaaguggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagaaacgcccuggacaaccuggccgugcugcacaccgccgaggugggcggcaaggccuacacccacgcccugagcgagcugcccgagacccuggagacccugcugcugcugacccugcuggccgccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggacuucggcuucggcagcaucaccacccaggagagcgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggagcccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacgugggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccaucgaggccggcagaacccugagagugcugaaccugguggagaacuggcugaacaacaacacccaguucugcaucaaggugcugaaccccuacaugcccagcgugaucgagaagauggagacccugcagagaaaguacggcggcgcccuggugagaaacccccugagcagaaacagcacccacgagauguacugggugagcaacgccaccggcaacaucgugagcagcgugaacaugaucagcagaaugcugaucaacagauucaccaugaagcacaagaaggccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacguggugcccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaaggagaagacccccagaaugugcaccagagaggaguucaccagaaaggugagaagcaacgccgcccugggcgccguguucaccgacgagaacaaguggaagagcgccagagaggccguggaggacggcagauucugggagcugguggacagagagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagaggcaacagccugagcggcguggagggcgagggccugcacagacugggcuacauccugagagaggugggcaagaaggagggcggcgccauguacgccgacgacaccgccggcugggacaccagaaucacccuggaggaccugaagaacgaggagauggugaccaaccacaugaagggcgagcacaagaagcuggccgaggccaucuucaagcugaccuaccagaacaagguggugagagugcagagacccacccccagaggcaccgugauggacaucaucagcagaaaggaccagagaggcagcggccaggugggcaccuacggccugaacaccuucaccaacauggaggcccagcugaucagacagauggagggcgagggcaucuucaagagcauccagcaccugaccgccaccgaggagaucgccgugcagaacuggcuggccagagugggcagagagagacugagcagaauggccaucagcggcgacgacugcguggugaagcccaucgacgacagauucgccagcgcccugaccgcccugaacgacaugggcaaggugagaaaggacauccagcagugggagcccagcagaggcuggaacgacuggacccaggugcccuucugcagccaccacuuccacgagcuggugaugaaggacggcagagugcugguggugcccugcagaaaccaggacgagcugaucggcagagccagaaucagccagggcgccggcuggagccugaaggagaccgccugccugggcaagagcuacgcccagauguggacccugauguacuuccacagaagagaccugagacuggccgccaacgccaucugcagcgccgugcccagccacugggugcccaccagcagaaccaccuggagcauccacgccaagcacgaguggaugaccaccgaggacaugcuggccguguggaacagaguguggauccaggagaaccccuggauggaggacaagacccccguggagagcugggaggaggugcccuaccugggcaagagagaggaccaguggugcggcagccugaucggccugaccagcagagccaccugggccaagaacauccagaccgccaucaaccaggugagaagccugaucggcaacgagggcuacaccgacuacaugcccagcaugaagagauucagaagagaggaggaggaggccggcgugcugugguga

SEQ ID NO: 17540 - RNA, 9876 nt, Artificial Sequence
  derived and/or modified CDS sequence (opt4) from DENV-2__JX286525__SS-prME
accgccggcgugaucgugaugcugauccccaccgccauggccuuccaccugaccaccagaaacggcgagccccacaugaucgugggcagacaggagaagggcaagagccugcuguucaagaccgaggacggcgugaacaugugcacccugauggccaucgaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgugcagagaaucgagaccuggauccugagacaccccggcuucaccaucauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaacgaggagcaggacaagagauucaucugcaagcacagcaugguggacagaggcuggggcaacggcugcggccuguucggcaagggcggcaucgugaccugcgccauguucaccugcaagaagaacauggagggcaagaucgugcagcccgagaaccuggaguacaccaucgugaucaccccccacagcggcgaggagcacgccgugggcaacgacaccggcaagcacggcaaggagaucaagaucaccccccagagcagcaccaccgaggccgagcugaccggcuacggcaccgugaccauggagugcagccccagaaccggccuggacuucaacgagauggugcugcugcagauggaggacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagaucgugaaggagaucgccgagacccagcacggcaccaucgugaucagagugcaguacgagggcgacggcagccccugcaagauccccuucgagaucaccgaccuggagaagagacacgugcugggcagacugaucaccgugaaccccaucgugaccgagaaggacagccccgugaacaucgaggccgagccccccuucggcgacagcuacaucaucgugggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcguggugacccuguaccugggcgccauggugcaggccgacagcggcugcaucgugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucaccaccaacaucuggcugaagcugagagagaagcaggacguguucugcgacagcaagcugaugagcgccgccaucaaggacaacagagccgugcacgccgacaugggcuacuggaucgagagcgcccugaacgacaccuggaagauggagaaggccagcuucaucgaggugaagagcugccacuggcccaagagccacacccuguggagcaacggcgugcuggagagcgagaugaucauccccaagagcuucgccggccccgugagccagcacaacuacagacccggcuaccacacccagaccgccggccccuggcaccugggcaagcuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugguggcccugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugauggccaccaucggcaucgcccugcugagccagagcacccugcccgagaccauccuggagcugaccgacgcccuggcccugggcaugauggcccugaagaucgugagaaacauggagaaguaccagcuggccgugaccaucauggccaucagcugcgugcccaacgccgugauccugcagaacgccuggaaggugagcugcaccauccuggccgccgugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggcguguuccccgugagcauccccaucaccgccgccgccugguaccugugggaggugaagaagcagagagccggcgugcugugggacgugcccagccccccccccgugggcaaggccgagcuggaggacggcgccuacagaaucaagcagagaggcauccugggcuacagccagaucggcgccggcguguacaaggagggcaccuuccacaccauguggcacgugaccagaggcgccgugcugaugcacagaggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggcaucuucaagaccaacaccggcaccaucggcgccgugagccuggacuucagccccggcaccagcggcagccccaucguggacagaaagggcaagguggugggccuguacggcaacggcguggugaccagaagcggcgccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccaucagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagagccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaaaguggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagaaacgcccuggacaaccuggccgugcugcacaccgccgaggugggcggcaaggccuacacccacgcccugagcgagcugcccgagacccuggagacccugcugcugcugacccugcuggccgccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggcuucggcagcaucaccacccaggagagcgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggagcccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacgugggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccaucgaggccggcagaacccugagagugcugaaccugguggagaacuggcugaacaacaacacccaguucugcaucaaggugcugaaccccuacaugcccagcgugaucgagaagauggagacccugcagagaaaguacggcggcgcccuggugagaaacccccugagcagaaacagcacccacgagauguacugggugagcaacgccaccggcaacaucgugagcagcgugaacaugaucagcagaaugcugaucaacagauucaccaugaagcacaagaaggccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacguggugcccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaaggagaagacccccagaaugugcaccagagaggaguucaccagaaaggugagaagcaacgccgcccugggcgccguguucaccgacgagaacaaguggaagagcgccagagaggccguggaggacggcagauucugggagcugguggacagagagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagaggcaacagccugagcggcguggagggcgagggccugcacagacugggcuacauccugagagaggugggcaagaaggagggcggcgccauguacgccgacgacaccgccggcugggacaccagaaucacccuggaggaccugaagaacgaggagauggugaccaaccacaugaagggcgagcacaagaagcuggccgaggccaucuucaagcugaccuaccagaacaagguggugagagugcagagacccacccccagaggcaccgugauggacaucaucagcagaaaggaccagagaggcagcggccaggugggcaccuacggccugaacaccuucaccaacauggaggcccagcugaucagacagauggagggcgagggcaucuucaagagcauccagcaccugaccgccaccgaggagaucgccgugcagaacuggcuggccagagugggcagagagagacugagcagaauggccaucagcggcgacgacugcguggugaagcccaucgacgacagauucgccagcgcccugaccgcccugaacgacaugggcaaggugagaaaggacauccagcagugggagcccagcagaggcuggaacgacuggacccaggugcccuucugcagccaccacuuccacgagcuggugaugaaggacggcagagugcugguggugcccugcagaaaccaggacgagcugaucggcagagccagaaucagccagggcgccggcuggagccugaaggagaccgccugccugggcaagagcuacgcccagauguggacccugauguacuuccacagaagagaccugagacuggccgccaacgccaucugcagcgccgugcccagccacugggugcccaccagcagaaccaccuggagcauccacgccaagcacgaguggaugaccaccgaggacaugcuggccguguggaacagaguguggauccaggagaaccccuggauggaggacaagacccccguggagagcugggaggaggugcccuaccugggcaagagagaggaccaguggugcggcagccugaucggccugaccagcagagccaccugggccaagaacauccagaccgccaucaaccaggugagaagccugaucggcaacgagggcuacaccgacuacaugcccagcaugaagagauucagaagagaggaggaggaggccggcgugcugugguga

SEQ ID NO: 17541 - RNA, 9876 nt, Artificial Sequence
  derived and/or modified CDS sequence (opt4) from DENV-2__KM279598__SS-prME
accgccggcaucaucaucaugaugauccccaccgugauggccuuccaccugaccaccagaaacggcgagccccacaugaucgugagcagacaggagaagggcaagagccugcuguucaagaccgagaacggcgugaacaugugcacccugauggccauggaccugggcgagcugugcgaggacaccaucaccuacaacugcccccugcugagacagaacgagcccgaggacaucgacugcuggugcaacagcaccagcaccugggugaccuacggcaccugcaccgccaccggcgagcacagaagagagaagagaagcguggcccuggugccccacgugggcaugggccuggagaccagaaccgagaccuggaugagcagcgagggcgccuggaagcacgcccagagaaucgagaccuggauccugagacaccccggcuucaccaucauggccgccauccuggccuacaccaucggcaccaccuacuuccagagagugcugaucuucauccugcugaccgccgugacccccagcauggccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcaccuggccacccugagaaaguacugcguggaggccaagcugaccaacaccaccaccgccagcagaugccccacccagggcgagcccagccugaacgaggagcaggacaagagauucgugugcaagcacagcaugguggacagaggcuggggcaacggcugcggccuguucggcaagggcggcaucgugaccugcgccauguucaccugcaagaagaacauggagggcaagguggugcagcccgagaaccuggaguacaccaucgugaucaccccccacagcggcgaggagaacgccgugggcaacgacaccggcaagcacggcaaggagaucaaggugaccccccagagcagcaucaccgaggccgagcugaccggcuacggcaccgugaccauggagugcagccccagaaccggccuggacuucaacgagauggugcugcugcagauggagaacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucgugaucagagugcaguacgagggcgacggcagccccugcaagauccccuucgagaucauggaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugagcugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcguggugaucaccuggaucggcaugaacagcagaagcaccagccugagcgugagccuggugcuggugggcguggugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugaccgagaacgaggugaagcugaccaucaugaccggcgacaucaagggcaucaugcaggccggcaagagaacccugagaccccagcccaccgagcugaaguacagcuggaaggccuggggcaaggccaagaugcugagcaccgagcugcacaaccacaccuuccugaucgacggccccgagaccgccgagugccccaacaccaacagagccuggaacagccuggagguggaggacuacggcuucggcguguucaccaccaacaucuggcugaagcugaaggagagacaggacguguucugcgacagcaagcugaugagcgccgccaucaaggacaacagagccgugcacgccgacaugggcuacuggaucgagagcgcccugaacgacaccuggaagaucgagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcagacuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugguggccgugagcuucgugacccugaucaccggcaacaugagcuucagagacgugggcagagugauggugauggugggcgccaccaugaccgacgacaucggcaugggcgugaccuaccuggcccugcuggccgccuucaagaucagacccaccuucgccgccggccugcugcugagaaagcugaccagcaaggagcugaugaugaccaccaucggcaucgugcugcugagccagagcaccauccccgagagcauccuggagcugaccgacgcccuggcccugggcaugauggugcugaagaucgugagaaacauggagaaguaccagcuggccgugaccaucauggccauccugugcgugcccaacgccgugauccugcagaacgccuggaaggugagcugcaccacccuggccguggugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugagaugggaggagcaggccgagaucagcggcagcagccccauccugagcaucaccaucagcgaggacggcagcaugagcaucaagaacgaggaggaggagcagacccugaccauccugaucagaaccggccugcuggugaucagcggccuguuccccgugagcauccccaucaccgccgccgccugguaccugugggaggugaagaagcagagagccggcgugcugugggacgugcccagccccccccccgugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacaagggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucguggacaagaagggcaagguggugggccuguacggcaacggcguggugaccagaagcggcaccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccaucagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagaaggagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacaucaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagagugggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacagaguggccgccgagggcaucaacuacgccgacagaagauggugcuucgacggcgugaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccaagaacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggacuucggccugggcagcaucaccacccagcagcccgagagcaacauccuggacaucgaccugagacccgccagcgccuggacccuguacgccguggccaccaccuucaucacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaugaccgugaucgaccuggaccccauccccuacgaccccaaguucgagaagcagcugggccaggugaugcugcuggugcugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccgccaacaccagaagaggcaccggcaacaccggcgagacccugggcgagaaguggaagaacagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaaccuggugacccccgagggcaaggugguggaccugggcugcggcagaggcggcuggagcuacuacugcggcggccugaagaacgugaaggaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccguggaggccggcagaacccugagagugcugaaccugguggagaacuggcugaacaacaacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccagcggcaacaucgugagcagcgugaacaugaucagcagaaugcugaucaacagauucaccaugagacacaagaaggccaccuacgagcccgacguggaccugggcagcggcaccagaaacaucggcaucgagagcgagacccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacgugauccccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcggcuucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacauggagggcgagcacaagaagcuggccgaggccaucuucaagcugaccuaccagaacaagguggugagagugcagagacccacccccagaggcaccgugauggacaucaucagcagaagagaccagagaggcagcggccagguggugaccuacggccugaacaccuucaccaacauggaggcccagcugaucagacagauggagggcgagggcguguucaagagcauccagcagcugaccgugaaggaggagaucgccgugaagaacuggcugaucagagugggcagagagagacugagcagaauggccaucagcggcgacgacugcguggugaagccccuggacgacagauucgccagcgcccugaccgcccugaacgacaugggcaaggugagaaaggacauccagcagugggagcccagcagaggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugagagagaccgccugccugggcaagagcuacgcccagauguggagccugauguacuuccacagaagagaccugagacuggccgccaacgccaucugcagcgccgugcccagccacuggauccccaccagcagaaccaccuggagcauccacgccacccacgaguggaugaccaccgaggacaugcugaccguguggaacagaguguggauccaggagaaccccuggauggaggacaagacccccguggagagcugggaggagauccccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 17542 - RNA, 9876 nt, Artificial Sequence
  derived and/or modified CDS sequence (opt4) from DENV-2__KM279576__SS-prME
accgccggcaucaucaucaugaugauccccaccgugauggccuuccaccugaccaccagaaacggcgagccccacaugaucgugagcagacaggagaagggcaagagccugcuguucaagaccgagaacggcgugaacaugugcacccugauggccauggaccugggcgagcugugcgaggacaccaucaccuacaacugcccccugcugagacagaacgagcccgaggacaucgacugcuggugcaacagcaccagcaccugggugaccuacggcaccugcaccgccaccggcgagcacagaagagagaagagaagcguggcccuggugccccacgugggcaugggccuggagaccagaaccgagaccuggaugagcagcgagggcgccuggaagcacgcccagagaaucgagaccuggauccugagacaccccggcuucaccaucauggccgccauccuggccuacaccaucggcaccaccuacuuccagagagugcugaucuucauccugcugaccgccgugacccccagcauggccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcaccuggccacccugagaaaguacugcguggaggccaagcugaccaacaccaccaccgccagcagaugccccacccagggcgagcccagccugaacgaggagcaggacaagagauucgugugcaagcacagcaugguggacagaggcuggggcaacggcugcggccuguucggcaagggcggcaucgugaccugcgccauguucaccugcaagaagaacauggagggcaagguggugcagcccgagaaccuggaguacaccaucgugaucaccccccacagcggcgaggagaacgccgugggcaacgacaccggcaagcacggcaaggagaucaaggugaccccccagagcagcaucaccgaggccgagcugaccggcuacggcaccgugaccauggagugcagccccagaaccggccuggacuucaacgagauggugcugcugcagauggagaacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucgugaucagagugcaguacgagggcgacggcagccccugcaagauccccuucgagaucauggaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugagcugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcguggugaucaccuggaucggcaugaacagcagaagcaccagccugagcgugagccuggugcuggugggcguggugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugaccgagaacgaggugaagcugaccaucaugaccggcgacaucaagggcaucaugcaggccggcaagagaacccugagaccccagcccaccgagcugaaguacagcuggaaggccuggggcaaggccaagaugcugagcaccgagcugcacaaccacaccuuccugaucgacggccccgagaccgccgagugccccaacaccaacagagccuggaacagccuggagguggaggacuacggcuucggcguguucaccaccaacaucuggcugaagcugaaggagagacaggacguguucugcgacagcaagcugaugagcgccgccaucaaggacaacagagccgugcacgccgacaugggcuacuggaucgagagcgcccugaacgacaccuggaagaucgagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcagacuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaagaucagacccaccuucgccgccggccugcugcugagaaagcugaccagcaaggagcugaugaugaccaccaucggcaucgugcugcugagccagagcaccauccccgagagcauccuggagcugaccgacgcccuggcccugggcaugauggugcugaagaucgugagaaacauggagaaguaccagcuggccgugaccaucauggccauccugugcgugcccaacgccgugauccugcagaacgccuggaaggugagcugcaccacccuggccguggugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugagaugggaggagcaggccgagaucagcggcagcagccccauccugagcaucaccaucagcgaggacggcagcaugagcaucaagaacgaggaggaggagcagacccugaccauccugaucagaaccggccugcuggugaucagcggccuguuccccgugagcauccccaucaccgccgccgccugguaccugugggaggugaagaagcagagagccggcgugcugugggacgugcccagccccccccccgugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacaagggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucguggacaagaagggcaagguggugggccuguacggcaacggcguggugaccagaagcggcaccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccaucagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagaaggagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacaucaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagagugggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacagaguggccgccgagggcaucaacuacgccgacagaagauggugcuucgacggcgugaagaacaaccagauccuggaggagaacguggagguggagaucuggaccaaggagggcgagagaaagaagcugaagcccagauggcuggacgccagaaccuacagcgacccccuggcccugaaggaguucaaggaguucgccgccggcagaaagagccugacccugaaccugaucaccgagaugggcagacugcccaccuucaugacccagaaggccaagaacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggacuucggccugggcagcaucaccacccagcagcccgagagcaacauccuggacaucgaccugagacccgccagcgccuggacccuguacgccguggccaccaccuucaucacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaugaccgugaucgaccuggaccccauccccuacgaccccaaguucgagaagcagcugggccaggugaugcugcuggugcugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccgccaacaccagaagaggcaccggcaacaccggcgagacccugggcgagaaguggaagaacagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaaccuggugacccccgagggcaaggugguggaccugggcugcggcagaggcggcuggagcuacuacugcggcggccugaagaacgugaaggaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccguggaggccggcagaacccugagagugcugaaccugguggagaacuggcugaacaacaacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccagcggcaacaucgugagcagcgugaacaugaucagcagaaugcugaucaacagauucaccaugagacacaagaaggccaccuacgagcccgacguggaccugggcagcggcaccagaaacaucggcaucgagagcgagacccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacgugauccccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcggcuucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacauggagggcgagcacaagaagcuggccgaggccaucuucaagcugaccuaccagaacaagguggugagagugcagagacccacccccagaggcaccgugauggacaucaucagcagaagagaccagagaggcagcggccagguggugaccuacggccugaacaccuucaccaacauggaggcccagcugaucagacagauggagggcgagggcguguucaagagcauccagcagcugaccgugaaggaggagaucgccgugaagaacuggcugaucagagugggcagagagagacugagcagaauggccaucagcggcgacgacugcguggugaagccccuggacgacagauucgccagcgcccugaccgcccugaacgacaugggcaaggugagaaaggacauccagcagugggagcccagcagaggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugagagagaccgccugccugggcaagagcuacgcccagauguggagccugauguacuuccacagaagagaccugagacuggccgccaacgccaucugcagcgccgugcccagccacuggauccccaccagcagaaccaccuggagcauccacgccacccacgaguggaugaccaccgaggacaugcugaccguguggaacagaguguggauccaggagaaccccuggauggaggacaagacccccguggagagcugggaggagauccccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 17543 - RNA, 9876 nt, Artificial Sequence
  derived and/or modified CDS sequence (opt4) from DENV-2__KC964095__SS-prME
agcgccggcaugaucaucaugcugauccccaccgugauggccuuccaccugaccaccagaaacggcgagccccacaugaucgugagcauccaggagaagggcaagagccugcuguucaagaccgaggacggcgugaacaugugcacccugauggccauggaccugggcgagcugugcgaggacaccaucaccuacaagugcccccugcugagacagaacgagcccgaggacaucgacagauggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgcccagagaaucgagaccuggauccugagacaccccggcuucaccaucauggccgccauccuggccuacaccaucggcaccacccacuuccagagagcccugaucuucauccugcugaccgccguggccccccccaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaaggaggagcaggacaagagauucgugugcaagcacagcaucguggacagaggcuggggcaacggcugcggcagcuucggcaagggcggcaucgugaccugcgccauguucaccugcaagaagaacauggagggcaagaucgugcagcccgagaaccuggaguacaccaucguggugaccccccacagcggcgaggagcacgccaucggcaacgacaccggcaagcacggcaaggagaucaaggugaccccccagagcagcgugaccgaggccgagcugaccggcuacggcaccgugaccaucgagugcagccccagaaccggccuggacuucaacgagauggugcugcugcagaugggcaacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcggccugagaauggacaagcugcagcugaagggcaugagcuacagcaugugcaccggcaaguucaagguggugaaggagaucgccgagacccagcacggcaccaucgugaucagagugcaguacgagggcgacggcagccccugcaagauccccuucgagaucauggaccuggagaagagauacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcaucgugacccuguaccugggcgugauggugcaggccgacagcggcugcguggugagcuggaagaacaaggagcugaagugcggcagcggcaucuucaucaccgacaacgugagaaccuggaccgagcaguacaaguuccagcccgagagccccagcaagcuggccagcgccauccagaaggcccaggaggagggcaucugcggcaucagaagcgugaccagacuggagaaccugauguggaagcagaucacccccgagcugaaccacauccuggccgagaacgaggugaagcugaccaucaugaccggcgacaucaagggcaccaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcauguucaccaccaacaucuggcugcagcugaaggagaagcaggacgccuucugcgacagcaagcugaugagcgccgccaucaaggacaacagagccgugcacgccgacaugggcuacuggaucgagagcgcccugaacgacaccuggaagaucgagaaggccagcuucaucgaggugaagaacugccacuggcccaagagccacacccuguggagcaacggcgugcuggagagcgagaugaucauccccaagaaccuggccggccccgugagccagcacaacuacagacccggcuaccacacccagaucgccggccccuggcaccagggcaagcccgagauggacuucgacuucugcgacggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugguggccgugagcuucgugacccugaucaccggcaacaugagcuucaaggaccugggcagagugguggugauggugggcgccaccaugaccgacgacaucggcaugggcgugaccuaccuggcccugcuggccgccuucaaggugagacccaccuucgccgccggccugcugcugagaaagcugaccagcaaggagcugaugaugaccaccaucggcaucgugcugcugagccagagcaccauccccgagaccgugcuggagcugaccgacgcccuggcccugggcaugauggcccugaagaucgugagagacauggagaaguaccagcuggccgugaccaucauggccauccugugcgugcccaacgccgugauccugcagaacgccuggaaggugagcugcaccauccuggccguggugagcgugagcccccugcugcugaccagcagccagcagaagaccgacuggaucccccuggcccugaccaucaagggccugaaccccaccgccaucuuccugaccacccugagcagaaccaacaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccaccgacgugaacugggaggaccaggccgagaucagcggcagcagccccauccugagcaucaccaucagcgaggacggcagcaugagcaucaagaacgaggaggaggagcagacccugaccauccugaucagaaccggccugcuggugaucagcggccuguuccccgugagcauccccaucaccgccgccgccugguaccugugggaggugaagaagcagagagccggcgugcugugggacgugcccagccccccccccaugggcaaggccgagcuggaggacggcgccuacagaaucaagcagaagggcgugcugggcuacagccagaucggcgccggcguguacaaggagggcaccuuccacaccauguggcacgugaccagaggcgccgugcugaugcacaagggcaagagaaucgagcccagcugggccgacgugaagaaggaccugaucagcuacggcggcggcuggaagcugggcggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucaucgacaagaagggcaagguggagggccuguacggcaacggcguggugaccagaagcggcaccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucaucgacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaagauggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaagaccagagacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcagaggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucaccacccagcagcccgagagcaacauccuggacaucgaccugccccccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggaccccauccccuacgaccccaaguucgagaagcagcugggccaggugaugcugcuggugcugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaucccccccgagaagugcgacacccugcugugcgacaucggcgaguggagccccaaccccaccguggaggccggcagaacccugagagugcugaaccugguggagaacuggcugaacaacaacacccaguucugcaucaaggugcugaaccccuacaugcccagcgugaucgagaagauggagacccugcagagaaaguacggcggcgcccuggugagaaacccccugagcagaaacagcacccacgagauguacugggugagcaacgccagcggcaacaucgugagcagcgugaacaugaucagcagaaugcugaucaacagauucaccaugagacacaagaaggccaccuacgagcccgacguggaccugggcagcggcaccagaaacaucggcaucgagagcgagacccccaaccuggacaucaucggcaagagaaucggcaagaucaagcaggagcacgagaccagcuggcacuacgaccaggaccaccccuacaagaccugggccuaccacggcagcuacgagaccaagcagaccggcagcgccagcagcaugguggacggcguggugagacugcugaccaagcccugggacgugauccccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaaggagacccccagaaugugcaccagagaggaguucaccagaaaggugagaagcaacgccgcccugggcgccaucuucaccgacgagaacaaguggaagagcgccagagaggccguggaggacagcggcuucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacauggagggcgagcacaagaagcuggccgaggccaucuucaagcugaccuaccagaacaagguggugagagugcagagacccccccccagaggcaccgugauggacaucaucagcagaagagaccagagaggcagcggccagguggugaccuacggccugaacaccuucaccaacauggaggcccagcugaucagacagauggagggcgagggcguguucaagaacauccagcaccugaccgugaccgaggagaucgccgugcagaacuggcuggccagagugggcagagagagacugagcagaauggccaucagcggcgacgacugcguggugaagccccuggacgacagauucgccagcgcccugaccgcccugaacgacgugggcaagaucagaaaggacauccagcagugggagcccagcagaggcugggacgacuggacccaggugcccuucugcagccaccacagccacgagcugaucaugaaggacggcagagugcugguggugcccugcagaaaccaggacgagcugaucggcagagccagaaucagccagggcgccggcuggagccugagagagaccgccugccugggcaagagcuacgcccagauguggagccugauguacuuccacagaagagaccugagacuggccgccaacgccaucugcagcgccgugcccagccacugggugcccaccagcagaaccaccuggagcauccacgccaagcacgaguggaugaccaccgaggacaugcugaccguguggaacagaguguggauccaggagaaccccuggauggaggacaagacccccguggagagcugggaggagauccccuaccugggcaagagagagggccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 17544 - RNA, 9876 nt, Artificial Sequence
  derived and/or modified CDS sequence (opt4) from DENV-2__KC964094__SS-prME
agcgccggcaugaucaucaugcugauccccaccgugauggccuuccaccugaccaccagaaacggcgagccccacaugaucgugagcauccaggagaagggcaagagccugcuguucaagaccgaggacggcgugaacaugugcacccugauggccauggaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgcccagagaaucgagaccugggugcugagacaccccggcuucaccaucauggccgccauccuggccuacaccaucggcaccaccuacuuccagagagugcugaucuucauccugcugaccgccguggcccccagcaugaccaugagaagcaucggcaucagcaacagagacuucguggagggcgugagcggcggcagcuggguggacguggugcuggagcacggcagcugcgugaccaccauggccaagaacaagcccacccuggacuucgagcugaccaagaccgaggccaagcaccccgccacccugagaaaguacugcaucgaggccaagcugaccaacaccaccaccgccagcagaugccccacccagggcgagcccagccugaacgaggagcaggacaagagauucgugugcaagcacagcaugguggacagaggcuggggcaacggcugcggccuguucggcaagggcggcaucgugaccugcgccauguucaccugcaagaagaacauggagggcaagguggugcagcccgagaaccuggaguacaccaucgugaucaccccccacagcggcgaggagaacgccgugggcaacgacaccggcaagcacggcaaggagaucaaggugaccccccagagcagcgugaccgaggccgagcugaccggcuacggcaccgugaccauggagugcagccccagaaccggccuggacuucaacgagauggugcugcugcagaugaagaacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaaccgacaagcugcagcugaagggcaugagcuacagcaugugcaccggcaaguucaagguggugaaggagaucgccgagacccagcacggcaccaucgugaucagagugcaguacgagggcgacggcagccccugcaagauccccuucgagaucauggaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugagcugguucaagaaggagagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcguggugaucaccuggaucggcaugaacagcagaagcaccagccugagcgugagccuggugcuggugggcguggugacccuguaccugggcgugauggugcaggccgacagcggcugcguggugagcuggaagaacaaggagcugaagugcggcagcggcaucuucgugaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaaggccuggggcaaggccaagaugcugagcaccgagcugcacaaccacaccuuccugaucgacggccccgagaccgccgagagacccaacaccaacagagccuggaacagccuggagguggaggacuacggcuucggcguguucaccaccaacaucuggcugaagcugaaggagagacaggacguguucugcgacagcaagcugaugagcgccgccaucaaggacaacagagccgugcacgccgacaugggcuacuggaucgagagcgcccugaacgacaccuggaagaucgagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcagacuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugaugaccaccaucggcaucgugcugcugagccagagcaccauccccgagaccauccuggagcugaccgacgcccuggcccugggcaugauggugcugaagaucgugagaaacauggagaaguaccagcuggccgugaccaucauggccauccugugcgugcccaacgccgugauccugcagaacgccuggaaggugagcugcaccacccuggccguggugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcuggccggcagaagcgccgaccuggagcuggagagagccgccgacgugagaugggaggagcaggccgagaucagcggcagcagccccauccugagcaucaccaucagcgaggacggcggcaugagcaucaagaacgaggaggaggagcagacccugaccauccugaucagaaccggccugcuggugaucagcggccuguuccccgugagcauccccaucaccgccgccgccugguaccugugggaggugaagaagcagagagccggcgugcugugggacgugcccagccccccccccgugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacaagggcaagagaaucgagcccagcugggccgacgugaagaaggaccugaucagcuacggcggcggcuggaagcuggagggcgaguggaaggagggcgaggagauccaggugcuggcccuggagcccggcaagaaccccagagccgugcagaccaagcccggccuguucaagaccaacaccggcaccaucggcgccgugagccuggacuucagccccggcaccagcggcagccccaucguggacaagaagggcaagguggugggccuguacggcaacggcguggugaccagaagcggcaccuacgugagcgccaucgcccagaccgagaagagcaucgaggacaaccccgagaucgaggacgacaccuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccaucagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcagaaaggugauccagcugagcagaaagaccagcgacagcgaguacaucaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagagugggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacagaguggccgccgagggcaucaacuacgccgacagaagauggugcuucgacggcgugaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagaaacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggacuucggccugggcagcaucgccacccagcagcccgagagcaacauccuggacaucgaccugagacccgccagcgccuggacccuguacgccguggccaccaccuucaucacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggaccccauccccuacgaccccaaguucgagaagcagcugggccaggugaugcugcuggugcugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccgccaacaccagaagaggcaccggcaacaccggcgagacccugggcgagaaguggaagaacagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaaccuggugacccccgagggcaaggugguggaccugggcugcggcagaggcggcuggagcuacuacugcggcggccugaagaacgugaaggaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccguggaggccggcagaacccugagagugcugaaccugguggagaacuggcugaacaacaacacccaguucugcaucaaggugcugaaccccuacaugcccagcgugaucgagaagauggaggcccugcagagaaaguacggcggcgcccuggugggcaacccccugagcagaaacagcacccacgagauguacugggccagcaacgccagcggcaacaucgugagcagcgugaacaugaucagcagaaugcugaucaacagauucaccaugagacacaagaaggccaccuacgagcccgacguggaccugggcagcggcaccagacacaucggcaucgagagcgagacccccaaccuggacaucaucggcaagagaaucgagaagaucaagcaggagcacgagaccagcuggcacugcgaccaggaccaccccuacaagaccugggccuaccacggcagcuacgaggccaagcagaccggcagcgccagcagcauggugaacggcguggugagacugcugaccaagcccugggacgugauccccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaaggcccccagaaugugcaccagagaggaguucaccagaaaggugagaagcaacgccgcccugggcgccauguucaccgacgagaacaaguggaagagcgccagagaggccguggaggacagcggcuucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacauggagggcgagcacaagaagcuggccgaggccaucuucaagcugaccuaccagaacaagguggugagagugcagagacccacccccagaggcaccgugauggacaucaucagcagaagagaccagagaggcagcggccagguggugaccuacggccugaacaccuucaccaacauggaggcccagcugaucagacagauggagggcgagggcguguucaagagcauccagcaccugaccgugaccgaggagaucgccgugaagaacuggcuggugagagugggcagagagagacugagcagaauggccaucagcggcgacgacugcguggugaagccccuggacgacagauucgccagcgcccugaccgcccugaacgacaugggcaaggugagaaaggacauccagcagugggagcccagcagaggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugagagagaccgccugccugggcaagagcuacgcccagauguggagccugauguacuuccacagaagagaccugagacuggccgccaacgccaucugcagcgccgugcccagccacugggugcccaccagcagaaccaccuggagcauccacgccacccacgaguggaugaccaccgaggacaugcugaccguguggaacagaguguggauccaggagaaccccuggauggaggacaagacccccguggagagcugggaggagauccccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 17545 - RNA, 9876 nt, Artificial Sequence
  derived and/or modified CDS sequence (opt4) from DENV-2__KC964093__SS-prME
accgccggcgugaucaucaugaugauccccaccgugguggccuuccaccugaccaccagaaacggcgagccccacaugaucgugagcagacaggagaagggcaagagccugcuguucaagaccgagaacggcgugaacaugugcacccugauggccauggaccugggcgagcugugcgaggacaccaucaccuacaacugcccccugcugagacagaacgagcccgaggacaucgacugcuggugcaacagcaccagcaccugggugaccuacggcaccugcaccgccaccggcgagcacagaagagagaagagaagcguggcccuggugccccacgugggcaugggccuggagaccagaaccgagaccuggaugagcagcgagggcgccuggaagcacgcccagagaaucgagaccugggugcugagacaccccggcuucaccaucauggccgccauccuggccuacaccaucggcaccaccuacuuccagagagugcugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaccaagaccgaggccaagcaccccgccacccugagaaaguacugcaucgaggccaagcugaccaacaccaccaccgccagcagaugccccacccagggcgagcccagccugaacgaggagcaggacaagagauucgugugcaagcacagcaugguggacagaggcuggggcaacggcugcggccuguucggcaagggcggcaucgugaccugcgccauguucaccugcaagaagaacauggagggcaagguggugcagcccgagaaccuggaguacaccaucgugaucaccccccacagcggcgaggagaacguggugggcaacgacaccggcaagcacggcaaggagaucaaggugaccccccagagcagcaucaccgaggccgagcugaccggcuacggcaccgugaccauggagugcagccccagaaccggccuggacuucaacgagauggugcugcugcagauggaggacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaaggccgugaaggagaucgccgagacccagcacggcaccaucgugaucagagugcaguacgagggcgacggcagccccugcaagauccccuucgagaucauggaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugagcugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcguggugaucaccuggaucggcaugaacagcagaagcaccagccugagcgugagccuggugcuggugggcguggugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaaggccuggggcaaggccaagaugcugagcaccgagcugcacaaccacaccuuccugaucgacggccccgagaccgccgagugccccaacaccaacagagccuggaacagccuggagguggaggacuacggcuucggcguguucaccaccaacaucuggcugaagcugaaggagagacaggacguguucugcgacagcaagcugaugagcgccgccaucaaggacaacagagccgugcacgccgacaugggcuacuggaucgagagcgcccugaacgacaccuggaagaucgagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcaagcuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugguggccgugagcuucgugacccugaucaccggcaacaugagcagcagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugaugaccaccaucggcaucgugcugcugagccagagcagcauccccgagaccauccuggagcugaccgacgcccuggcccugggcaugauggugcugaagaucgugagaaacauggagaaguaccagcuggccgugaccaucauggccauccugugcgugcccaacgccgugauccugcagaacgccuggaaggugagcugcaccacccuggccguggugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcuggccggcagaagcgccgaccuggagcuggagagagccgccgacgugagaugggaggagcaggccgagaucagcggcagcagccccauccugagcaucaccaucagcgaggacggcggcaugagcaucaagaacgaggaggaggagcagacccugaccauccugaucagaaccggccugcuggugaucagcggccuguuccccgugagcauccccaucaccgccgccgccugguaccugugggaggugaagaagcagagagccggcgugcugugggacgugcccagccccccccccgugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacaagggcaagagaaucgagcccagcugggccgacgugaagaaggaccugaucagcuacggcggcggcuggaagcuggagggcgaguggaaggagggcgaggagauccaggugcuggcccuggagcccggcaagaaccccagagccgugcagaccaagcccggccuguucaagaccaacaccggcaccaucggcgccgugagccuggacuucagccccggcaccagcggcagccccaucguggacaagaagggcaagguggugggccuguacggcaacggcguggugaccagaagcggcaccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccaucagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagagugggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagagaguggacgccaucgacggcgaguacagacugagaggcgaggccagaaagaccuucguggaccugaugagaagaggcgaccugcccguguggcuggccuacagaguggccgccgagggcaucaacuacgccgacagaagauggugcuucgacggcgugaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagaaacgcccuggacgaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcgugcugcugugguacgcccagauccagccccacuggaucgccgccagcaucauccuggaguucuuccugaucgugcugcugauccccgagcccgagaagcagagaaccccccaggacaaccagcugaccuacguggccaucgccauccugaccgugguggccgccaccauggccaacgagaugggcuuccuggagaagaccaagaaggacuucggccugggcagcaucgccacccagcagcccgagagcaacauccuggaccuggaccugagacccgccagcgccuggacccuguacgccguggccaccaccuucaucacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggaccccauccccuacgaccccaaguucgagaagcagcugggccaggugaugcugcuggugcugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgugggccugcuguucagcaucaugaagaacaccgccaacaccagaagaggcaccggcaacaccggcgagacccugggcgagaaguggaagaacagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaaccuggugacccccgagggcaaggugauggaccugggcugcggcagaggcggcuggagcuacuacugcggcggccugaagaacgugaaggaggugaagggccugaccaagggcggccccggccacgaggagcccauccccaugagcaccuacggcuggaaccuggugagacugcagagcggcguggacguguucuucgccccccccgagaagugcgacacccugcugugcgacaucggcgagagcagccccaaccccaccguggaggccggcagaacccugagagugcugaaccugguggagaacuggcugaacaacaacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccagcggcaacaucgugagcagcgugaacaugaucagcagaaugcugaucaacagauucaccaugagacacaagaaggccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacgugauccccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcggcuucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagaggugagcaagaaggagggcggcgccauguacgccgacgacaccgccggcugggacaccagaaucacccuggaggaccugaagaacgaggagauggugaccaaccacauggagggcgagcacaagaagcuggccgaggccaucuucaagcugaccuaccagaacaagguggugagagugcagagacccacccccagaggcaccgugauggacaucaucagcagaagagaccagagaggcagcggccagguggugaccuacggccugaacaccuucaccaacauggaggcccagcugaucagacagauggagggcgagggcguguucaagagcauccagcaccugaccgugaccgaggagaucgccgugaagaacuggcugaccagagugggcagagagagacugagcagaauggccaucagcggcgacgacugcguggugaagccccuggacgacagauucgccagcgcccugaccgcccugaacgacaugggcaaggugagaaaggacauccagcagugggagcccagcagaggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugagagagaccgccugccugggcaagagcuacgcccagauguggagccugauguacuuccacagaagagaccugagacuggccgccaacgccaucugcagcgccgugcccagccacugggugcccaccagcagaaccaccuggagcauccacgccacccacgaguggaugaccaccgaggacaugcugaccguguggaacagaguguggauccaggagaaccccuggauggaggacaagacccccguggagagcugggaggagauccccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggagggcgaggccggcgugcugugguga

SEQ ID NO: 17546 - RNA, 9876 nt, Artificial Sequence
  derived and/or modified CDS sequence (opt4) from DENV-2__DQ448231__SS-prME
accgccggcgugaucaucaugcugauccccaccgccauggccuuccaccugaccaccagaaacggcgagccccacaugaucgugagcagacaggagaagggcaagagccugcuguucaagaccgaggacggcgugaacaugugcacccugauggccauggaccugggcgagcugugcgaggacaccaucaccuacaacugcccccugcugagacagaacgagcccgaggacaucgacugcuggugcaacagcaccagcaccugggugaccuacggcaccugcaccgccaccggcgagcacagaagagagaagagaagcguggcccuggugccccacgugggcaugggccuggagaccagaaccgagaccuggaugagcagcgagggcgccuggaagcacgcccagagaaucgagaccuggauccugagacaccccggcuucaccaucauggccgccauccuggccuacaccaucggcaccaccuacuuccagagagugcugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgccagcagaugccccacccagggcgagcccagccugaacgaggagcaggacaagagauucgugugcaagcacagcaugguggacagaggcuggggcaacggcugcggccuguucggcaagggcggcaucgugaccugcgccauguucaccugcaagaagaacauggagggcaagaucgugcagcccgagaaccuggaguacaccaucguggugaccccccacagcggcgaggagaacaccgugggcaacgacaccggcaagcacggcaaggagaucaaggugaccccccagagcagcaucaccgaggccgagcugaccggcuacggcaccgugaccauggagugcagccccagaaccggccuggacuucaacgagauggugcugcugcagauggagaacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucguggugagagugcaguacgagggcgacggcagccccugcaagauccccuucgagaucauggaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugagcugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcguggugaucaccuggaucggcaugaacagcagaagcaccagccugagcgugagccuggugcuggugggcguggugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaagaccuggggcaaggccaagauccugagcaccgagccccacaaccagaccuuccugaucgacggccccgagaccgccgagugccccaacaccaacagagccuggaacagccuggagguggaggacuacggcuucggcguguucaccaccaacaucuggcugaagcugaaggagagacaggacguguucugcgacagcaagcugaugagcgccgccaucaaggacaacagagccgugcacgccgacaugggcuacuggaucgagagcgcccugaacgacaccuggaagaucgagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcaagcuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccgugcugcugguggccgugagcuucaugacccugaucaccggcaacaugagcuucagagaccugggcagagugauggugauggugggcgccgccaugaccgacgacaucggcaugggcgugaccuaccuggcccugcuggccgccuucaaggugagacccaccuucgccgccggccugcugcugagaaagcugaccagcaaggagcugaugaugaccaccaucggcaucgugcugcugagccagagcaccauccccgagaccauccuggagcugaccgacgcccuggcccugggcaugaugauccugaagaucgugagaaacauggagaaguaccagcuggccgugaccaucauggccauccugugcgugcccaacgccgugauccugcagaacgccuggaaggugagcugcaccauccuggccguggugagcgugagcccccugcugcugaccagcagccagcagaaggccgacuggaucccccuggcccugaccaucaagggccugaaccccaccgccaucuuccugaccacccugagcagaaccaacaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugagaugggaggaccaggccgagaucagcggcagcagccccauccugagcaucaccaucagcgaggacggcagcaugagcaucaagaacgaggaggaggagcagacccugaccauccugaucagaaccggccugcuggugaucagcggccuguuccccgugagcauccccaucaccgccgccgccugguaccugugggaggugaagaagcagagagccggcgugcugugggacgugcccagccccccccccgugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacaagggcaagagaaucgagcccagcugggccgacgugagaaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucguggacaagaagggcaagguggugggccuguacggcaacggcguggugaccagaagcggcaccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacaucaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacagaguggccgccgagggcaucaacuacgccgacagaagauggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagaaacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggacuucggccugggcagcaucgccacccagcagcccgagagcaacauccuggacaucgaccugagacccgccagcgccuggacccuguacgccguggccaccaccuucaucacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggaccccauccccuacgaccccaaguucgagaagcagcugggccaggugaugcugcuggugcugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaccggcgagacccugggcgagaaguggaagaacagacugaacagccugggcaagagcgaguuccagaucuacaagagaagcggcauccaggagguggacagaacccuggccaaggagggcaucaagagaggcgagaccgaccaccacgccgugagcagaggcagcgccaagcugagaugguucguggagagaaaccuggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccguggaggccggcagaacccugagagugcugaaccugguggagaacuggcugaacaacaacacccaguucugcaucaaggugcugaaccccuacaugcccagcgugaucgagaagauggagacccugcagagaaaguacggcggcgcccuggugagaaacccccugagcagaaacagcacccacgagauguacugggugagcaacgccagcggcaacaucgugagcagcgugaacaugaucagcagaaugcugaucaacagauucaccaugagacacaagaaggccaccuacgagcccgacguggaccugggcagcggcaccagaaacaucggcaucgagagcgagacccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacgugauccccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcagauucugggagcugguggacaaggagagaaaccugcaccuggagggcaagugcgagaccugcguguacaacaugaugggcaagagagagaagaagaucggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagaggugagcaagaaggagggcggcgccauguacgccgacgacaccgccggcugggacaccagaaucacccuggaggaccugaagaacgaggagauggugaccaaccacauggagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacaugggcgcccagcugaucagacagauggagggcgagggcguguucaagggcauccagcaccugaccgccaccgaggagguggccgugcaggacuggcuggccagagugggcagagagagacugagcagaauggccaucagcggcgacgacugcguggugaagccccuggacgacagauucgccagcgcccugaccgcccugaacgacaugggcaagaucagaaaggacauccagcagugggagcccagcagaggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugagagagaccgccugccugggcaagagcuacgcccagauguggagccugauguacuuccacagaagagaccugagacuggccgccaacgccaucugcagcgccgugcccagccacugggugcccaccagcagaaccaccuggagcauccacgccagacacgaguggaugaccaccgaggacaugcugaccguguggaacagaguguggauccaggagaaccccuggauggaggacaagacccccguggagagcugggaggagauccccuaccugggcaagagagaggaccaguggugcggcagccugaucggccugaccagcagagccaccugggccaagaacauccagaccgccaucaaccaggugagaagccugaucggcagcgaggaguacaccgacuacaugcccagcaugaagagauucagaagagaggaggaggaggccggcgugcugugguga

SEQ ID NO: 17547 - RNA, 9876 nt, Artificial Sequence
  derived and/or modified CDS sequence (opt4) from DENV-2__JX470186__SS-prME
accgccggcaucaucaucaugaugauccccaccgugauggccuuccaccugaccaccagaaacggcgagccccacaugaucgugagcagacaggagaagggcaagagccugcuguucaagaccgagaacggcgugaacaugugcacccugauggccauggaccugggcgagcugugcgaggacaccaucaccuacaacugcccccugcugagacagaacgagcccgaggacaucgacugcuggugcaacagcaccagcaccugggugaccuacggcaccugcaccgccaccggcgagcacagaagagagaagagaagcguggcccuggugccccacgugggcaugggccuggagaccagaaccgagaccuggaugagcagcgagggcgccuggaagcacgcccagagaaucgagaccugggugcugagacaccccggcuucaccaucauggccgccauccuggccuacaccaucggcaccaccuacuuccagagagugcugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcaccccgccacccugagaaaguacugcaucgaggccaagcugaccaacaccaccaccgccagcagaugccccacccagggcgagcccagccugaacgaggagcaggacaagagauucgugugcaagcacagcaugguggacagaggcuggggcaacggcugcggccuguucggcaagggcggcaucgugaccugcgccauguucaccugcaagaagaacauggagggcaagaucgugcagcccgagaaccuggaguacaccaucgugaucaccccccacagcggcgaggagaacgccgugggcaacgacaccggcaagcacggcaaggagaucaaggugaccccccagagcagcaucaccgaggccgagcugaccggcuacggcaccgugaccauggagugcagccccagaaccggccuggacuucaacgagauggugcugcugcagauggagaacaaggccuggcuggcccacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucgugaucagagugcaguacgagggcgacggcagccccugcaagauccccuucgagaucauggaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugagcugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcguggugaucaccuggaucggcaugaacagcagaagcaccagccugagcgugagccuggugcuggugggcguggugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaaggccuggggcaaggccaagaugcugagcaccgagcugcacaaccacaccuuccugaucgacggccccgagaccgccgagugccccaacaccaacagagccuggaacagccuggagguggaggacuacggcuucggcguguucaccaccaacaucuggcugaagaugaaggagagacaggacguguucugcgacagcaagcugaugagcgccgccaucaaggacagcagagccgugcacgccgacaugggcuacuggaucgagagcgcccugaacgacaccuggaagaucgagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcagacuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugaugaccaccaucggcaucgugcugcugagccaggccaccauccccgagaccauccuggagcugaccgacgcccuggcccugggcaugauggugcugaagaucgugagaaacauggagaaguaccagcuggccgugaccaucauggccauccugugcgugcccaacgccgugauccugcagaacgccuggaaggugagcugcaccacccuggccguggugagcgugagcccccugcugcugaccagcagccagcagaaggccgacuggaucccccuggcccugaccaucaagggccugaaccccaccgccaucuuccugaccacccugagcagaaccaacaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugagaugggaggagcaggccgagaucagcggcagcagccccauccugagcaucaccaucagcgaggacggcagcaugagcaucaagaacgaggaggaggagcagacccugaccauccugaucagaaccggccugcugguggugagcggccuguuccccgugagcacccccaucaccgccgccgccugguaccugugggaggugaagaagcagagagccggcgugcugugggacgugcccagccccccccccgugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacaagggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucguggacaagaagggcaagguggugggccuguacggcaacggcguggugaccagaagcggcaccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccaucagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacaucaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagagugggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacagaguggccgccgagggcaucaacuacgccgacagaagauggugcuucgacggcgugaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagaaacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggacuucggccugggcagcaucaccacccagcagcccgagaacaacauccuggacaucgaccugagacccgccagcgccuggacccuguacgccguggccaccaccuucaucacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggaccccauccccuacgaccccaaguucgagaagcagcugggccaggugaugcugcuggugcugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccgccaacaccagaagaggcaccggcaacaccggcgagacccugggcgagaaguggaagaacagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaaccuggugacccccgagggcaaggugguggaccugggcugcggcagaggcggcuggagcuacuacugcggcggccugaagaacgugaaggaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccguggaggccggcagaacccugagagugcugaaccugguggagaacuggcugaacaacaacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccagcggcaacaucgugagcagcgugaacaugaucagcagaaugcugaucaacagauucaccaugagacacaagaaggccaccuacgagcccgacguggaccugggcagcggcaccagaaacaucggcaucgagagcgagacccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacgugauccccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcggcuucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacauggagggcgagcacaagaagcuggccgaggccaucuucaagcugaccuaccagaacaagguggugagagugcagagacccacccccagaggcaccgugauggacaucaucagcagaagagaccagagaggcagcggccagguggugaccuacggccugaacaccuucaccaacauggaggcccagcugaucagacagauggagggcgagggcguguucaagagcauccagcagcugaccgugaccgaggagaucgccgugaagaacuggcuggugagagugggcagagagagacugagcagaauggccaucagcggcgacgacugcguggugaagccccuggacgacagauucgccagcgcccugaccgcccugaacgacaugggcaaggugagaaaggacauccagcagugggagcccagcagaggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugagagagaccgccugccugggcaagagcuacgcccagauguggagccugauguacuuccacagaagagaccugagacuggccgccaacgccaucugcagcgccgugcccagccacugggugcccaccagcagaaccaccuggagcauccacgccacccacgaguggaugaccaccgaggacaugcugaccguguggaacagaguguggauccaggagaaccccuggauggaggacaagacccccguggagagcugggaggagauccccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 17548 - RNA, 9876 nt, Artificial Sequence
  derived and/or modified CDS sequence (opt4) from DENV-2__KU517846__SS-prME
accgccggcaucaucaucaugaugauccccaccgugauggccuuccaccugaccaccagaaacggcgagccccacaugaucgugagcagacaggagaagggcaagagccugcuguucaagaccgagaacggcgugaacaugugcacccugauggccauggaccugggcgagcugugcgaggacaccaucaccuacaacugcccccugcugagacagaacgagcccgaggacaucgacugcuggugcaacagcaccagcaccugggugaccuacggcaccugcaccgccaccggcgagcacagaagagagaagagaagcguggcccuggugccccacgugggcaugggccuggagaccagaaccgagaccuggaugagcagcgagggcgccuggaagcacgcccagagaaucgagaccugggugcugagacaccccggcuucaccaucauggccgccauccuggccuacaccaucggcaccaccuacuuccagagagugcugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcaccccgccacccugagaaaguacugcaucgaggccaagcugaccaacaccaccaccgccagcagaugccccacccagggcgagcccagccugaacgaggagcaggacaagagauucgugugcaagcacagcaugguggacagaggcuggggcaacggcugcggccuguucggcaagggcggcaucgugaccugcgccauguucaccugcaagaagaacauggagggcaagaucgugcagcccgagaaccuggaguacaccaucgugaucaccccccacagcggcgaggagaacgccgugggcaacgacaccggcaagcacggcaaggagaucaaggugaccccccagagcagcaucaccgaggccgagcugaccggcuacggcaccgugaccauggagugcagccccagaaccggccuggacuucaacgagauggugcugcugcagauggagaacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucgugaucagagugcaguacgagggcgacggcagccccugcaagauccccuucgagaucauggaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugagcugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcguggugaucaccuggaucggcaugaacagcagaagcaccagccugagcgugagccuggugcuggugggcaucgugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaaggccuggggcaaggccaagaugcugagcaccgagcugcacaaccacaccuuccugaucgacggccccgagaccgccgagugccccaacaccaacagagccuggaacagccuggagguggaggacuacggcuucggcguguucaccaccaacaucuggcugaagcugaaggagagacaggacguguucugcgacagcaagcugaugagcgccgccaucaaggacaacagagccgugcacgccgacaugggcuacuggaucgagagcgcccugaacgacaccuggaagaucgagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcagacuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugguggccgugagcuucaugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugaugaccaccaucggcaucgugcugcugagccagagcaccauccccgagaccauccuggagcugaccgacgcccuggcccugggcaugauggugcugaagaucgugagaaacauggagaaguaccagcuggccgugaccaucauggccauccugugcgugcccaacgccgugauccugcagaacgccuggaaggugagcugcaccauccuggccguggugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugagaugggaggagcaggccgagaucagcggcagcagccccauccugagcaucaccaucagcgaggacggcagcaugagcaucaagaacgaggaggaggagcugacccugaccauccugaucagaaccggccugcuggugaucagcggccuguuccccgugagcauccccaucaccgccgccgccugguaccugugggaggugaagaagcagagagccggcgugcugugggacgugcccagccccccccccgugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacaagggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucguggacaagaagggcaagguggugggccuguacggcaacggcguggugaccagaagcggcaccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccaucagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacaucaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagagugggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacagaguggccgccgagggcaucaacuacgccgacagaagauggugcuucgacggcgugaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagaaacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggacuucggccugggcagcaucaccacccagcagcccgagagcaacauccuggacaucgaccugagacccgccagcgccuggacccuguacgccguggccaccaccuucaucacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggaccccauccccuacgaccccaaguucgagaagcagcugggccaggugaugcugcuggugcugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccgccaacaccagaagaggcaccggcaacaccggcgagacccugggcgagaaguggaagaacagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaaccuggugacccccgagggcaaggugguggaccugggcugcggcagaggcggcuggagcuacuacugcggcggccugaagaacgugaaggaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccguggaggccggcagaacccugagagugcugaaccugguggagaacuggcugaacaacaacacccaguucugcaucaaggugcugagccccuacaugcccagcgugaucgagaagauggaggcccugcagagaaaguacggcggcgcccuggugagaaacccccugagcagaaacagcacccacgagauguacugggugagcaacgccagcggcaacaucgugagcagcgugaacaugaucagcagaaugcugaucaacagauucaccaugagacacaagaaggccaccuacgagcccgacguggaccugggcagcggcaccagaaacaucggcaucgagagcgagacccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacgugauccccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcggcuucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacauggagggcgagcacaagaagcuggccgaggccaucuucagacugaccuaccagaacaagguggugagagugcagagacccacccccagaggcaccgugauggacaucaucagcagaagagaccagagaggcagcggccagguggugaccuacggccugaacaccuucaccaacauggaggcccagcugaucagacagauggagggcgagggcguguucaagagcauccagcaccugaccgugaccgaggagaucgccgugaagaacuggcuggagagagugggcagagagagacugagcagaauggccaucagcggcgacgacugcguggugaagccccuggacgacagauucgccagcgcccugaccgcccugaacgacaugggcaagaucagaaaggacauccagcagugggagcccagcagaggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugagagagaccgccugccugggcaagagcuacgcccagauguggagccugauguacuuccacagaagagaccugagacuggccgccaacgccaucugcagcgccgugcccagccacugggugcccaccagcagaaccaccuggagcauccacgccacccacgaguggaugaccaccgaggacaugcugaccguguggaacagaguguggauccaggagaaccccuggauggaggacaagacccccguggagagcugggaggagauccccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 17549 - RNA, 9876 nt, Artificial Sequence
  derived and/or modified CDS sequence (opt4) from DENV-2__KJ830750__SS-prME
accgccggcgugaucaucaugcugauccccaccgccauggccuuccaccugaccaccagaaacggcgagccccacaugaucgugagcaagcaggagaagggcaagagccugcuguucaagaccgaggacggcgugaacaugugcacccugauggccauggaccugggcgagcugugcgaggacaccaucaccuacaacugcccccugcugagacagaacgagcccgaggacaucgacugcuggugcaacagcaccagcaccugggugaccuacggcaccugcaccgccaccggcgagcacagaagagagaagagaagcguggcccuggugccccacgugggcaugggccuggagaccagaaccgagaccuggaugagcagcgagggcgccuggaagcacgcccagagaaucgagaccuggauccugagacaccccggcuucaccaucauggccgccauccuggccuacaccaucggcaccaccuacuuccagagagugcugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgccagcagaugccccacccagggcgagcccagccugaacgaggagcaggacaagagauucgugugcaagcacagcaugguggacagaggcuggggcaacggcugcggccuguucggcaagggcggcaucgugaccugcgccauguucaccugcaagaagaacauggagggcaagaucgugcagcccgagaaccuggaguacaccaucguggugaccccccacagcggcgaggagaacgccgugggcaacgacaccggcaagcacggcaaggagaucaaggugaccccccagagcagcaucaccgaggccgagcugaccggcuacggcaccgugaccauggagugcagccccagaaccggccuggacuucaacgagauggugcugcugcagauggagaacaaggccuggcuggugcacagacagugguuccuggaccugccccugcccuggcugcccggcgccgacauccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucguggugagagugcaguacgagggcgacggcagccccugcaagauccccuucgagaucauggaccuggagaagagacacgugcugggcagacugaucaccgugaaccccaucgugaccggcaaggacagccccgugaacaucgaggccgagccccccuucggcgacagcuacaucaucaucggcguggagcccggccagcugaagcugagcugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcguggugaucaccuggaucggcaugaacagcagaagcaccagccugagcgugagccuggugcuggugggcguggugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugagcaucaugaccggcgacaucaagggcaucaugcaggccggcaagagaagccugagaccccagcccaccgagcugaaguacagcuggaagaccuggggcaaggccaagaugcugagcaccgagccccacaaccagaccuuccugaucgacggccccgagaccgccgagugccccaacaccaacagagccuggaacagccuggagguggaggacuacggcuucggcguguucaccaccaacaucuggcugaagcugaaggagagacaggacgugagcugcgacagcaagcugaugagcgccgccaucaaggacaacagagccgugcacgccgacaugggcuacuggaucgagagcgcccugaacgacaccuggaagaucgagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcaagcuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccgugcugcugguggccgugagcuucaugacccugaucaccggcaacaugagcuucagagaccugggcagagugauggugauggugggcgccgccaugaccgacgacaucggcaugggcgugaccuaccuggcccugcuggccgccuucaaggugagacccaccuucgccgccggccugcugcugagaaagcugaccagcaaggagcugaugaugaccaccaucggcaucgugcugcugagccagagcaccacccccgagagcauccuggagcugaccgacgcccuggcccugggcaugaugauccugaagaucgugagaaacauggagaaguaccagcuggccgugaccaucauggccauccugugcgugcccaacgccgugauccugcagaacgccuggaaggugagcugcaccauccuggccgccgugagcgugagcccccugcugcugaccagcagccagcagaaggccgacuggaucccccuggcccugaccaucaagggccugaaccccaccgccaucuuccugaccacccugagcagaaccaacaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagaaggccgccgacgugagaugggaggaccaggccgagaucagcggcagcagccccauccugagcaucaccaucagcgaggacggcagcaugagcaucaagaacgaggaggaggagcagacccugaccauccugaucagaaccggccugcuggugaucagcggccuguuccccgugagcauccccaucaccgccgccgccugguaccugugggaggugaagaagcagagagccggcgugcugugggacgugcccagccccccccccgugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacaagggcaagagaaucgagcccagcugggccgacgugagaaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucguggacaagaagggcaagguggugggccuguacggcaacggcguggugaccagaagcggcaccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacaucaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacagaguggccgccgagggcaucaacuacgccgacagaagauggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagaaacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggacuucggccugggcagcaucgccauccagcagcccgagagcaacauccuggacaucgaccugagacccgccagcgccuggacccuguacgccguggccaccaccuucaucacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcgugaccgugaucgaccuggaccccauccccuacgaccccaaguucgagaagcagcugggccaggugaugcugcuggugcugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaccggcgagacccugggcgagaaguggaagaacagacugaacagccugggcaagagcgaguuccagaucuacaagagaagcggcauccaggagguggacagaacccuggccaaggagggcaucaagagaggcgagaccgaccaccacgccgugagcagaggcagcgccaagcugagaugguucguggagagaaaccuggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccguggaggccggcagaacccugagagugcugaaccugguggagaacuggcugaacaacaacacccaguucugcaucaaggugcugaaccccuacaugcccagcgugaucgagaagauggagacccugcagagaaaguacggcggcgcccuggugagaaacccccugagcagaaacagcacccacgagauguacugggugagcaacgccagcggcaacaucgugagcagcgugaacaugaucagcagaaugcugaucaacagauucaccaugagacacaagaaggccaccuacgagcccgacguggaccugggcagcggcaccagaaacaucggcaucgagagcgagacccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacgugauccccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucgccagaaaggugagaagcaacgccgcccugggcgccaucuucaccgacgagaacaaguggaagagcgccagagaggccguggaggacagcagauucugggagcugguggacaaggagagaaaccugcaccuggagggcaagugcgagaccugcguguacaacaugaugggcaagagagagaagaagaucggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagaggugagcaagaaggagggcggcgccauguacgccgacgacaccgccggcugggacaccagaaucacccuggaggaccugaagaacgaggagauggugaccaaccacauggagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacaugggcgcccagcugaucagacagauggagggcgagggcguguucaagggcauccagcaccugaccgccaccgaggagguggccgugcaggacuggcuggccagagugggcagagagagacugagcagaauggccaucagcggcgacgacugcguggugaagccccuggacgacagauucgccagcgcccugaccgcccugaacgacaugggcaaggugagaaaggacauccagcagugggagcccagcagaggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugagagagaccgccugccugggcaagagcuacgcccagauguggagccugauguacuuccacagaagagaccugagacuggccgccaacgccaucugcagcgccgugcccagccacugggugcccaccagcagaaccaccuggagcauccacgccggccacgaguggaugaccaccgaggacaugcugaccguguggaacagaguguggauccaggagaaccccuggauggaggacaagacccccguggagagcugggaggagauccccuaccugggcaagagagaggaccaguggugcggcagccugaucggccugaccagcagagccaccugggccagaaacauccagaccgccaucaaccaggugagaagccugaucggcagcgaggaguacaccgacuacaugcccagcaugaagagauucagaagagaggaggaggaggccggcgugcugugguga

SEQ ID NO: 17550 - RNA, 9876 nt, Artificial Sequence
  derived and/or modified CDS sequence (opt4) from DENV-2__FM210231__SS-prME
agcgccggcaugaucaucaugcugauccccaccgugauggccuuccaccugaccaccagaaacggcgagccccacaugaucgugggcauccaggagaagggcaagagccugcuguucaagaccgaggacggcgugaacaugugcacccugauggccauggaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgcccagagaaucgagaccuggauccugagacaccccggcuucaccaucauggccgccauccuggccuacaccaucggcaccacccacuuccagagagugcugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaaggaggagcaggacaagagauucgugugcaagcacagcaugguggacagaggcuggggcaacggcugcggccuguucggcaagggcggcaucgugaccugcgccauguucaccugcaagaagaacauggagggcaagaucgugcagcccgagaaccuggaguacaccaucguggugaccccccacagcggcgaggagcacgccgugggcaacgacaccggcaagcacggcaaggagaucaaggugaccccccagagcagcaucaccgaggccgagcugaccggcuacggcaccgugaccauggagugcagccccagaaccggccuggacuucaacgagauggugcugcugcagauggagaacaaggccuggcuggugcacagacagugguuccuggaccugccccugcccuggcugcccggcgccgacaagcaggagagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucgugaucagagugcaguacgagggcgacggcagccccugcaagauccccuucgagaucauggaccuggagaagagauacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcaucgugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccaggaggagggcaucugcggcaucagaagcgugaccagacuggagaaccugauguggaagcagaucacccccgagcugaaccacauccuggccgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagcuacaaccagaccuuccugaucgacggccccgagaccgccgagugccccaacaccaacagagccuggaacagccuggagguggaggacuacggcuucggcguguucaccaccaacaucuggcugaagcugaaggagaagcaggacgccuucugcgacagcaagcugaugagcgccgccaucaaggacaacagagccgugcacgccgacaugggcuacuggaucgagagcgcccugaacgacaccuggaagaucgagaaggccagcuucaucgaggugaagaacugccacuggcccaagagccacacccuguggagcaacggcgugcuggagagcgagaugaucauccccaagaaccuggccggccccgugagccagcacaacuacagacccggcuaccacacccagaucgccggccccuggcaccugggcaagcuggagauggacuucgacuucugcgacggcaccaccgugaucgugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagguggacaacuucagccugggcgugcugggcauggcccuguuccuggaggagaugcugagaaccagagugggcaccaagcacgccauccugcugguggccgugagcuucgugacccugaucaccggcaacaugagcuucaaggaccugggcagagugguggugauggugggcgccaccauggccgacgacaucggcaugggcgugaccuaccuggcccugcuggccgccuucaaggugagacccaccuucgccgccggccugcugcugagaaagcugaccagcaaggagcugaugaugaccaccaucggcaucgugcugcugagccagagcaccauccccgagaccgugcuggagcugaccgacgcccuggcccugggcaugauggugcugaagaucgugagaaacauggagaaguaccagcuggccgugaccaucauggccauccugugcgugcccaacgccguggugcugcagaacgccuggaaggugagcugcaccauccuggccguggugagcgugagcccccugcugcugaccagcagccagcagaagaccgacuggaucccccuggcccugaccaucaagggccugaaccccaccgccaucuuccugaccacccugagcagaaccaacaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccaccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggccuguuccccaucagcauccccaucaccgccgccgccugguaccugugggaggugaagaagcagagagccggcgugcugugggacgugcccagccccccccccaugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacaagggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucaucgacaagaagggcaagguggugggccuguacggcaacggcguggugaccagaagcggcgccuacgugagcgccaucgcccagaccgagaagagcaucgaggacaaccccgagaucgaggacgacaucuucagaaagagaagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucaaggccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucaucgacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaagauggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaagaccagagacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcagaggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucgugacccagcagcccgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggaccccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagagcgugagagaggugaagggccugaccaagggcggccccggccacgaggagcccauccccaugagcaccuacggcuggaaccuggugagacugcagagcggcguggacguguucuucaucccccccgagaagugcgacacccugcugugcgacaucggcgagagcagccccaaccccaccguggaggccggcagaacccugagagugcugaaccugguggagaacuggcugaacaacaacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccagcggcaacaucgugagcagcgugaacaugaucagcagaaugcugaucaacagauucaccaugagacacaagaaggccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacgugcugcccaccgugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcagauucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacauggagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcguguucaagaacauccagcaccugaccgugaccgaggagguggccgugcagaacuggcuggccagagugggcagagagagacugagcagaauggccaucagcggcgacgacugcguggugaagccccuggacgacagauucgccaacgcccugaccgcccugaacgacaugggcaagaucagaaaggacauccagcagugggagcccagcaagggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugagagagaccgccugccugggcaagagcuacgcccagauguggagccugauguacuuccacagaagagaccugagacuggccgccaacgccaucugcagcgccgugcccagccacugggugcccaccagcagaaccaccuggagcauccacgccaagcacgaguggaugaccaccgaggacaugcugaccguguggaacagaguguggaucagagagaaccccuggauggaggacaagacccccguggagagcugggaggagauccccuaccugggcaagagagaggaccaguggugcggcagccugaucggccugaccagcagagccaccugggccaagaacauccaggccgccaucaaccaggugagaagccugaucggcaacgaggaguacaccgacuacaugcccagcaugaagagauucagaagagaggaggaggaggccggcgugcugugguga

SEQ ID NO: 17551 - RNA, 9876 nt, Artificial Sequence
  derived and/or modified CDS sequence (opt4) from DENV-2__FM210239__SS-prME
accgccggcgugaucaucaugcugauccccaccgccauggccuuccaccugaccaccagaaacggcgagccccacaugaucgugggcagacaggagaagggcaagagccugcuguucaagaccgaggacggcgugaacaugugcacccugauggccaucgaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgcccagagaaucgagaccuggauccugagacaccccggcuucaccaucauggccgccauccuggccuacaccgugggcaccacccacuuccagagagcccugaucuucauccugcuggccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaacgaggagcaggacaagagauucgugugcaagcacagcaugguggacagaggcuggggcaacggcugcggccuguucggcaagggcggcaucgugaccugcgccauguucaccugcaagaagaacauggagggcaagaucgugcagcccgagaaccuggaguacaccaucgugaucaccccccacagcggcgaggagcacgccgugggcaacgacaccggcaagcacggcaaggagaucaagaucaccccccagagccccaucaccgaggccgagcugaccggcuacggcaccgugaccauggagugcagccccagaaccggccuggacuucaacgagauggugcugcugcagauggaggacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagaucgugaaggagaucgccgagacccagcacggcaccaucgugaucagagugcaguacgagggcgacggcagccccugcaagauccccuucgagaucauggaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcgugaucacccuguaccugggcgccauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucaccaccaacaucuggcugaagcugagagagaagcaggacguguucugcgacagcaagcugaugagcgccgccaucaaggacaacagagccgugcacgccgacaugggcuacuggaucgagagcgcccugaacgacaccuggaagauggagaaggccagcuucaucgaggugaagagcugccacuggcccaagagccacacccuguggagcaacggcgugcuggagagcgagaugaucauccccaagagcuucgccggccccgugagccagcacaacuacagacccggcuacuacacccagaccgccggccccuggcaccugggcaagcuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcuggugaccgugagcuucgugacccugaucaccggcaacaugagcuucagagaccugggcagagugauggugauggugggcgccgccaugaccgacgacaucggcaugggcgugaccuaccuggcccugcuggccgccuucaaggugagacccaccuucgccgccggccugcugcugagaaagcugaccagcaaggagcugaugauggccaccaucggcaucgcccugcugagccagagcaccauccccgagaccauccuggagcugaccgacgcccuggcccugggcaugauggugcugaagaucgugagaaacauggagaaguaccagcuggccgugaccaucauggccaucagcugcgugcccaacgccgugauccugcagaacgccuggaaggugagcugcaccauccuggccgccgugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccaccgacgugaagugggaggaccaggccgagaucagcggcagcagccccauccugagcaucaccaucgccgaggacggcagcaugagcaucaagaacgaggaggaggagcagacccugaccauccugaucagaaccggccugcuggugaucagcggccuguuccccgugagcauccccaucaccgccgccgccugguaccugugggaggugaagaagcagagagccggcgugcugugggacgugcccagccccccccccgugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacagaggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucguggacagaaagggcaagguggugggccuguacggcaacggcguggugaccagaagcggcgccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaagaaccuucguggaccugaugagaagaggcgaccugcccguguggcuggccuacagaguggccgccgagggcaucaacuacgccgacagaagauggugcuucgacggcgugaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagagacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcgugggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucgccacccaggagcccgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcgugaccgugaucgaccuggaccccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaaggacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccaucgaggccggcagaacccugagagugcugagccugguggagaacuggcugaacaacgacacccaguucugcaucaaggugcugaaccccuacaugcccagcgugaucgagaagauggagacccugcagagaaaguacggcggcgcccuggugagaaacccccugagcagaaacagcacccacgagauguacugggugagcaacgccaccggcaacaucgugagcagcgugaacaugaucagcagaaugcugaucaacagauucaccaugaagcacaagaaggccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacguggugcccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcagauucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacauggagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcguguucaagagcauccagagacugaccgugaccgaggagaucgccgugcagaacuggcuggccagagugggcagagagagacugagcagaauggccaucagcggcgacgacugcguggugaagccccuggacgacagauucgccagcgcccugaccgcccugaacgacaugggcaaggugagaaaggacauccagcagugggagcccagcagaggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugaaggagaccgccugccugggcaagagcuacgcccagauguggagccugauguacuuccacagaagagaccugagacuggccgccaacgccaucugcagcgccgugcccagccacugggugcccaccagcagaaccaccuggagcauccacgccaagcacgaguggaugaccaccgaggacaugcugaccguguggaacagaguguggauccaggagaaccccuggauggaggacaagacccccguggagagcugggaggaggugcccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 17552 - RNA, 9876 nt, Artificial Sequence
  derived and/or modified CDS sequence (opt4) from DENV-2__FM210232__SS-prME
accgccggcgugaucaucaugcugauccccaccgccauggccuuccaccugaccaccagaaacggcgagccccacaugaucgugggcagacaggagaagggcaagagccugcuguucaagaccgaggacggcgugaacaugugcacccugauggccaucgaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgcccagagaaucgagaccuggauccugagacaccccggcuucaccaucauggccgccauccuggccuacaccgugggcaccacccacuuccagagagcccugaucuucauccugcuggccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaacgaggagcaggacaagagauucgugugcaagcacagcaugguggacagaggcuggggcaacggcugcggccuguucggcaagggcggcaucgugaccugcgccauguucaccugcaagaagaacauggagggcaagaucgugcagcccgagaaccuggaguacaccaucgugaucaccccccacagcggcgaggagcacgccgugggcaacgacaccggcaagcacggcaaggagaucaagaucaccccccagagccccaucaccgaggccgagcugaccggcuacggcaccgugaccauggagugcagccccagaaccggccuggacuucaacgagauggugcugcugcagauggaggacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagaucgugaaggagaucgccgagacccagcacggcaccaucgugaucagagugcaguacgagggcgacggcagccccugcaagauccccuucgagaucauggaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcgugaucacccuguaccugggcgccauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucaccaccaacaucuggcugaagcugagagagaagcaggacguguucugcgacagcaagcugaugagcgccgccaucaaggacaacagagccgugcacgccgacaugggcuacuggaucgagagcgcccugaacgacaccuggaagauggagaaggccagcuucaucgaggugaagagcugccacuggcccaagagccacacccuguggagcaacggcgugcuggagagcgagaugaucauccccaagagcuucgccggccccgugagccagcacaacuacagacccggcuacuacacccagaccgccggccccuggcaccugggcaagcuggagauggacuucgacuucugcgagggcaccaccgugguggugaccgaggccugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcuggugaccgugagcuucgugacccugaucaccggcaacaugagcuucagagaccugggcagagugauggugauggugggcgccgccaugaccgacgacaucggcaugggcgugaccuaccuggcccugcuggccgccuucaaggugagacccaccuucgccgccggccugcugcugagaaagcugaccagcaaggagcugaugauggccaccaucggcaucgcccugcugagccagagcaccauccccgagaccauccuggagcugaccgacgcccuggcccugggcaugauggugcugaagaucgugagaaacauggagaaguaccagcuggccgugaccaucauggccaucagcugcgugcccaacgccgugauccugcagaacgccuggaaggugagcugcaccauccuggccgccgugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccaccgacgugaagugggaggaccaggccgagaucagcggcagcagccccauccugagcaucaccaucgccgaggacggcagcaugagcaucaagaacgaggaggaggagcagacccugaccauccugaucagaaccggccugcuggugaucagcggccuguuccccgugagcauccccaucaccgccgccgccugguaccugugggaggugaagaagcagagagccggcgugcugugggacgugcccagccccccccccgugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacagaggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucguggacagaaagggcaagguggugggccuguacggcaacggcguggugaccagaagcggcgccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacagaguggccgccgagggcaucaacuacgccgacagaagauggugcuucgacggcgugaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagagacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcgugggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucgccacccaggagcccgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcgugaccgugaucgaccuggaccccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaaggacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccaucgaggccggcagaacccugagagugcugagccugguggagaacuggcugaacaacgacacccaguucugcaucaaggugcugaaccccuacaugcccagcgugaucgagaagauggagacccugcagagaaaguacggcggcgcccuggugagaaacccccugagcagaaacagcacccacgagauguacugggugagcaacgccaccggcaacaucgugagcagcgugaacaugaucagcagaaugcugaucaacagauucaccaugaagcacaagaaggccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacguggugcccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcagauucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacauggagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcguguucaagagcauccagcaccugaccgugaccgaggagaucgccgugcagaacuggcuggccagagugggcagagagagacugagcagaauggccaucagcggcgacgacugcguggugaagccccuggacgacagauucgccagcgcccugaccgcccugaacgacaugggcaaggugagaaaggacauccagcagugggagcccagcagaggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugaaggagaccgccugccugggcaagagcuacgcccagauguggagccugauguacuuccacagaagagaccugagacuggccgccaacgccaucugcagcgccgugcccagccacugggugcccaccagcagaaccaccuggagcauccacgccaagcacgaguggaugaccaccgaggacaugcugaccguguggaacagaguguggauccaggagaaccccuggauggaggacaagacccccguggagagcugggaggaggugcccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 17553 - RNA, 9876 nt, Artificial Sequence
  derived and/or modified CDS sequence (opt4) from DENV-2__FM210233__SS-prME
agcgccggcaugaucaucaugcugauccccaccgugauggccuuccaccugaccaccagaaacggcgagccccacaugaucgugggcauccaggagaagggcaagagccugcuguucaagaccgaggacggcgugaacaugugcacccugauggccauggaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgcccagagaaucgagaccuggauccugagacaccccggcuucaccaucauggccgccauccuggccuacaccaucggcaccacccacuuccagagagugcugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaaggaggagcaggacaagagauucgugugcaagcacagcaugguggacagaggcuggggcaacggcugcggccuguucggcaagggcggcaucgugaccugcgccauguucaccugcaagaagaacauggagggcaagaucgugcagcccgagaaccuggaguacaccaucguggugaccccccacagcggcgaggagcacgccgugggcaacgacaccggcaagcacggcaaggagaucaaggugaccccccagagcagcaucaccgaggccgagcugaccggcuacggcaccgugaccauggagugcagccccagaaccggccuggacuucaacgagauggugcugcugcagauggagaacaaggccuggcuggugcacagacagugguuccuggaccugccccugcccuggcugcccggcgccgacaagcaggagagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucgugaucagagugcaguacgagggcgacggcagccccugcaagauccccuucgagaucauggaccuggagaagagauacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcaucgugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccaggaggagggcaucugcggcaucagaagcgugaccagacuggagaaccugauguggaagcagaucacccccgagcugaaccacauccuggccgagaacgaggugaagcugaccaucaugaccggcgacaucagaggcaucaugcaggccggcaagagaagccugagaccccagcccaccgagcugaaguacagcuggaagaccuggggcaaggccaagaugcugagcaccgagagcuacaaccagaccuuccugaucgacggccccgagaccgccgagugccccaacaccaacagagccuggaacagccuggagguggaggacuacggcuucggcguguucaccaccaacaucuggcugaagcugaaggagaagcaggacgccuucugcgacagcaagcugaugagcgccgccaucaaggacaacagagccgugcacgccgacaugggcuacuggauggagagcgcccugaacgacaccuggaagaucgagaaggccagcuucaucgaggugaagaacugccacuggcccaagagccacacccuguggagcaacggcgugcuggagagcgagaugaucauccccaagaaccuggccggccccgugagccagcacaacuacagacccggcuaccacacccagaucgccggccccuggcaccugggcaagcuggagauggacuucgacuucugcgacggcaccaccgugaucgugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagguggacaacuucagccugggcgugcugggcauggcccuguuccuggaggagaugcugagaaccagagugggcaccaagcacgccauccugcugguggccgugagcuucgugacccugaucaccggcaacaugagcuucaaggaccugggcagagugguggugauggugggcgccaccauggccgacgacaucggcaugggcgugaccuaccuggcccugcuggccgccuucaaggugagacccaccuucgccgccggccugcugcugagaaagcugaccagcaaggagcugaugaugaccaccaucggcaucgugcugcugagccagagcaccauccccgagaccgugcuggagcugaccgacgcccuggcccugggcaugauggugcugaagaucgugagaaacauggagaaguaccagcuggccgugaccaucauggccauccugugcgugcccaacgccgugauccugcagaacgccuggaaggugagcugcaccauccuggccguggugagcgugagcccccugcugcugaccagcagccagcagaagaccgacuggaucccccuggcccugaccaucaagggccugaaccccaccgccaucuuccugaccacccugagcagaaccaacaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccaccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggccuguuccccaucagcauccccaucaccgccgccgccugguaccugugggaggugaagaagcagagagccggcgugcugugggacgugcccagccccccccccaugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacaagggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucaucgacaagaagggcaagguggugggccuguacggcaacggcguggugaccagaagcggcgccuacgugagcgccaucgcccagaccgagaagagcaucgaggacaaccccgagaucgaggacgacaucuucagaaagagaagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucaucgacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaagauggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaagaccagagacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcagaggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagagagaccugggccugggcagcaucgccacccagcagcccgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggaccccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaucccccccgagaagugcgacacccugcugugcgacaucggcgagagcagccccaaccccaccguggaggccggcagaacccugagagugcugaaccugguggagaacuggcugaacaacaacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccagcggcaacaucgugagcagcgugaacaugaucagcagaaugcugaucaacagauucaccaugagacacaagaaggccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacgugcugcccaccgugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcagauucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacauggagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcguguucaagaacauccagcaccugaccgugaccgaggagguggccgugcacaacuggcuggccagagugggcagagagagacugagcagaauggccaucagcggcgacgacugcguggugaagccccuggacgacagauucgccaacgcccugaccgcccugaacgacaugggcaagaucagaaaggacauccagcagugggagcccagcaagggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugagagagaccgccugccugggcaagagcuacgcccagauguggagccugauguacuuccacagaagagaccugagacuggccgccaacgccaucugcagcgccgugcccagccacugggugcccaccagcagaaccaccuggagcauccacgccaagcacgaguggaugaccaccgaggacaugcugaccguguggaacagaguguggaucagagagaaccccuggauggaggacaagacccccguggagagcugggaggagauccccuaccugggcaagagagaggaccaguggugcggcagccugaucggccugaccagcagagccaccugggccaagaacauccaggccgccaucaaccaggugagaagccugaucggcaacgaggaguacaccgacuacaugcccagcaugaagagauucagaagagaggaggaggaggccggcgugcugugguga

SEQ ID NO: 17554 - RNA, 9876 nt, Artificial Sequence
  derived and/or modified CDS sequence (opt4) from DENV-2__FM210241__SS-prME
accgccggcgugaucaucaugcugauccccaccgccauggccuuccaccugaccaccagaaacggcgagccccacaugaucgugggcagacaggagaagggcaagagccugcuguucaagaccgaggacggcgugaacaugugcacccugauggccaucgaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgcccagagaaucgagaccuggauccugagacaccccggcuucaccaucauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaacgaggagcaggacaagagauucgugugcaagcacagcaugguggacagaggcuggggcaacggcugcggccuguucggcaagggcggcaucgugaccugcgccauguucaccugcaagaagaacauggagggcaagaucgugcagcccgagaaccuggaguacaccaucgugaucaccccccacagcggcgaggagcacgccgugggcaacgacaccggcaagcacggcaaggagaucaagaucaccccccagagcagcaucaccgaggccgagcugaccggcuacggcaccgugaccauggagugcagccccagaaccggccuggacuucaacgagauggugcugcugcagauggaggacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagaucgugaaggagaucgccgagacccagcacggcaccaucgugaucagagugcaguacgagggcgacggcagccccugcaagauccccuucgagaucauggaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgccaucaucaccuggaucggcaugaacagcagaagcaccagccugagcgugagccuggugcuggugggcgugaucacccuguaccugggcgccauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucaccaccaacaucuggcugaagcugagagagaagcaggacguguucugcgacagcaagcugaugagcgccgccaucaaggacaacagagccgugcacgccgacaugggcuacuggaucgagagcgcccugaacgacaccuggaagauggagaaggccagcuucaucgaggugaagagcugccacuggcccaagagccacacccuguggagcaacggcgugcuggagagcgagaugaucauccccaagagcuucgccggccccgugagccagcacaacuacagacccggcuacuacacccagaccgccggccccuggcaccugggcaagcuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugauggccaccaucggcaucgcccugcugagccagagcaccauccccgagaccauccuggagcugaccgacgcccuggcccugggcaugauggugcugaagaucgugagaaacauggagaaguaccagcuggccgugaccaucauggccaucagcugcgugcccaacgccgugauccugcagaacgccuggaaggugagcugcaccauccuggccgccgugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccaccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggccuguuccccgugagcauccccaucaccgccgccgccugguaccugugggaggugaagaagcagagagccggcgugcugugggacgugcccagccccccccccgugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacagaggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucguggacagaaagggcaagguggugggccuguacggcaacggcguggugaccagaagcggcgccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucaucgacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacagaguggccgccgagggcaucaacuacgccgacagaagauggugcuucgacggcgugaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagagacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcgugggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucgccacccaggagcccgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugagccugaucgcccacuacgccaucaucggccccggccugcaggccaaggccaccagagaggcccagaagagagccgccgccggcaucaugaagaaccccaccguggacggcaucaccgugaucgaccuggaccccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccaucgaggccggcagaacccugagagugcugagccugguggagaacuggcugaacaacgacacccaguucugcaucaaggugcugaaccccuacaugcccagcgugaucgagaagauggagacccugcagagaaaguacggcggcgcccuggugagaaacccccugagcagaaacagcacccacgagauguacugggugagcaacgccaccggcaacaucgugagcagcgugaacaugaucagcagaaugcugaucaacagauucaccaugaagcacaagaaggccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacguggugcccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcagauucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacauggagggcgagcacaagagacuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccaguucaucagacagauggagggcgagggcaucuucaagagcauccagcaccugaccgugaccgaggagaucgccgugcagaacuggcuggccagagugggcagagagagacugagcagaauggccaucagcggcgacgacugcguggugaagccccuggacgacagauucgccagcgcccugaccgcccugaacgacaugggcaaggugagaaaggacauccagcagugggagcccagcaagggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugaaggagaccgccugccugggcaagagcuacgcccagauguggagccugauguacuuccacagaagagaccugagacuggccgccaacgccaucugcagcgccgugcccagccacugggugcccaccagcagaaccaccuggagcauccacgccaagcacgaguggaugaccaccgaggacaugcugaccguguggaacagaguguggauccaggagaaccccuggauggaggacaagacccccguggagagcugggaggaggugcccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 17555 - RNA, 9876 nt, Artificial Sequence
  derived and/or modified CDS sequence (opt4) from DENV-2__FM210242__SS-prME
agcgccggcaugaucaucaugcugauccccaccgugauggccuuccaccugaccaccagaaacggcgagccccacaugaucgugggcauccaggagaagggcaagagccugcuguucaagaccgaggacggcgugaacaugugcacccugauggccauggaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgcccagagaaucgagaccuggauccugagacaccccggcuucaccaucauggccgccauccuggccuacaccaucggcaccacccacuuccagagagugcugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaaggaggagcaggacaagagauucgugugcaagcacagcaugguggacagaggcuggggcaacggcugcggccuguucggcaagggcggcaucgugaccugcgccauguucaccugcaagaagaacauggagggcaagaucgugcagcccgagaaccuggaguacaccaucguggugaccccccacagcggcgaggagcacgccgugggcaacgacaccggcaagcacggcaaggagaucaaggugaccccccagagcagcaucaccgaggccgagcugaccggcuacggcaccgugaccauggagugcagccccagaaccggccuggacuucaacgagauggugcugcugcagauggagaacaaggccuggcuggugcacagacagugguuccuggaccugccccugcccuggcugcccggcgccgacaagcaggagagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucgugaucagagugcaguacgagggcgacggcagccccugcaagauccccuucgagaucauggaccuggagaagagauacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcaucgugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccaggaggagggcaucugcggcaucagaagcgugaccagacuggagaaccugauguggaagcagaucacccccgagcugaaccacauccuggccgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagcuacaaccagaccuuccugaucgacggccccgagaccgccgagugccccaacaccaacagagccuggaacagccuggagguggaggacuacggcuucggcguguucaccaccaacaucuggcugaagcugaaggagaagcaggacgccuucugcgacagcaagcugaugagcgccgccaucaaggacaacagagccgugcacgccgacaugggcuacuggaucgagagcgcccugaacgacaccuggaagaucgagaaggccagcuucaucgaggugaagaacugccacuggcccaagagccacacccuguggagcaacggcgugcuggagagcgagaugaucauccccaagaaccuggccggccccgugagccagcacaacuacagacccggcuaccacacccagaucgccggccccuggcaccugggcaagcuggagauggacuucgacuucugcgacggcaccaccgugaucgugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagguggacaacuucagccugggcgugcugggcauggcccuguuccuggaggagaugcugagaaccagagugggcaccaagcacgccauccugcugguggccgugagcuucgugacccugaucaccggcaacaugagcuucaaggaccugggcagagugguggugauggugggcgccaccauggccgacgacaucggcaugggcgugaccuaccuggcccugcuggccgccuucaaggugagacccaccuucgccgccggccugcugcugagaaagcugaccagcaaggagcugaugaugaccaccaucggcaucgugcugcugagccagagcaccauccccgagaccgugcuggagcugaccgacgcccuggcccugggcaugauggugcugaagaucgugagaaacauggagaaguaccagcuggccgugaccaucauggccauccugugcgugcccaacgccguggugcugcagaacgccuggaaggugagcugcaccauccuggccguggugagcgugagcccccugcugcugaccagcagccagcagaagaccgacuggaucccccuggcccugaccaucaagggccugaaccccaccgccaucuuccugaccacccugagcagaaccaacaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccaccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggccuguuccccaucagcauccccaucaccgccgccgccugguaccugugggaggugaagaagcagagagccggcgugcugugggacgugcccagccccccccccaugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacaagggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucaucgacaagaagggcaagguggugggccuguacggcaacggcguggugaccagaagcggcgccuacgugagcgccaucgcccagaccgagaagagcaucgaggacaaccccgagaucgaggacgacaucuucagaaagagaagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucaaggccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucaucgacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaagauggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaagaccagagacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcagaggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucgccacccagcagcccgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggaccccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagagcgugagagaggugaagggccugaccaagggcggccccggccacgaggagcccauccccaugagcaccuacggcuggaaccuggugagacugcagagcggcguggacguguucuucaucccccccgagaagugcgacacccugcugugcgacaucggcgagagcagccccaaccccaccguggaggccggcagaacccugagagugcugaaccugguggagaacuggcugaacaacaacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccagcggcaacaucgugagcagcgugaacaugaucagcagaaugcugaucaacagauucaccaugagacacaagaaggccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacgugcugcccaccgugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcagauucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacauggagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcguguucaagaacauccagcaccugaccgugaccgaggagguggccgugcagaacuggcuggccagagugggcagagagagacugagcagaauggccaucagcggcgacgacugcguggugaagccccuggacgacagauucgccaacgcccugaccgcccugaacgacaugggcaagaucagaaaggacauccagcagugggagcccagcaagggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugagagagaccgccugccugggcaagagcuacgcccagauguggagccugauguacuuccacagaagagaccugagacuggccgccaacgccaucugcagcgccgugcccagccacugggugcccaccagcagaaccaccuggagcauccacgccaagcacgaguggaugaccaccgaggacaugcugaccguguggaacagaguguggaucagagagaaccccuggauggaggacaagacccccguggagagcugggaggagauccccuaccugggcaagagagaggaccaguggugcggcagccugaucggccugaccagcagagccaccugggccaagaacauccaggccgccaucaaccaggugagaagccugaucggcaacgaggaguacaccgacuacaugcccagcaugaagagauucagaagagaggaggaggaggccggcgugcugugguga

SEQ ID NO: 17556 - RNA, 9876 nt, Artificial Sequence
  derived and/or modified CDS sequence (opt4) from DENV-2__FM210243__SS-prME
accgccggcgugaucaucaugcugauccccaccgccauggccuuccaccugaccaccagaaacggcgagccccacaugaucgugggcagacaggagaagggcaagagccugcuguucaagaccgaggacggcgugaacaugugcacccugauggccaucgaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgcccagagaaucgagaccuggauccugagacaccccggcuucaccaucauggccgccauccuggccuacaccgugggcaccacccacuuccagagagcccugaucuucauccugcuggccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaacgaggagcaggacaagagauucgugugcaagcacagcaugguggacagaggcuggggcaacggcugcggccuguucggcaagggcggcaucgugaccugcgccauguucaccugcaagaagaacauggagggcaagaucgugcagcccgagaaccuggaguacaccaucgugaucaccccccacagcggcgaggagcacgccgugggcaacgacaccggcaagcacggcaaggagaucaagaucaccccccagagcagcaucaccgaggccgagcugaccggcuacggcaccgugaccauggagugcagccccagaaccggccuggacuucaacgagauggugcugcugcagauggaggacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagaucgugaaggagaucgccgagacccagcacggcaccaucgugaucagagugcaguacgagggcgacggcagccccugcaagauccccuucgagaucauggaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcaucaucacccuguaccugggcgccauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucaccaccaacaucuggcugaagcugagagagaagcaggacguguucugcgacagcaagcugaugagcgccgccaucaaggacaacagagccgugcacgccgacaugggcuacuggaucgagagcgcccugaacgacaccuggaagauggagaaggccagcuucaucgaggugaagagcugccacuggcccaagagccacacccuguggagcaacggcgugcuggagagcgagaugaucauccccaagagcuucgccggccccgugagccagcacaacuacagacccggcuacuacacccagaccgccggccccuggcaccugggcaagcuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcuggugaccgugagcuucgugacccugaucaccggcaacaugagcuucagagaccugggcagagugauggugauggugggcgccgccaugaccgacgacaucggcaugggcgugaccuaccuggcccugcuggccgccuucaaggugagacccaccuucgccgccggccugcugcugagaaagcugaccagcaaggagcugaugauggccaccaucggcaucgcccugcugagccagagcaccauccccgagaccauccuggagcugaccgacgcccuggcccugggcaugauggugcugaagaucgugagaaacauggagaaguaccagcuggccgugaccaucauggccaucagcugcgugcccaacgccgugauccugcagaacgccuggaaggugagcugcaccauccuggccgccgugagcguguucccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccaccgacgugaagugggaggaccaggccgagaucagcggcagcagccccauccugagcaucaccaucgccgaggacggcagcaugagcaucaagaacgaggaggaggagcagacccugaccauccugaucagaaccggccugcuggugaucagcggccuguuccccgugagcauccccaucaccgccgccgccugguaccugugggaggugaagaagcagagagccggcgugcugugggacgugcccagccccccccccgugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacagaggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucguggacagaaagggcaagguggugggccuguacggcaacggcguggugaccagaagcggcgccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacagaguggccgccgagggcaucaacuacgccgacagaagauggugcuucgacggcgugaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagagacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcgugggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucgccacccaggagcccgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggaccccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccaucgaggccggcagaacccugagagugcugagccugguggagaacuggcugaacaacgacacccaguucugcaucaaggugcugaaccccuacaugcccagcgugaucgagaagauggagacccugcagagaaaguacggcggcgcccuggugagaaacccccugagcagaaacagcacccacgagauguacugggugagcaacgccaccggcaacaucgugagcagcgugaacaugaucagcagaaugcugaucaacagauucaccaugaagcacaagaaggccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacguggugcccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcagauucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacauggagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcaucuucaagagcauccagcaccugaccgugaccgaggagaucgccgugcagaacuggcuggccagagugggcagagagagacugagcagaauggccaucagcggcgacgacugcguggugaagccccuggacgacagauucgccagcgcccugaccgcccugaacgacaugggcaaggugagaaaggacauccagcagugggagcccagcagaggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugaaggagaccgccugccugggcaagagcuacgcccagauguggagccugauguacuuccacagaagagaccugagacuggccgccaacgccaucugcagcgccgugcccagccacugggugcccaccagcagaaccaccuggagcauccacgccaagcacgaguggaugaccaccgaggacaugcugaccguguggaacagaguguggauccaggagaaccccuggauggaggacaagacccccguggagagcugggaggaggugcccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 17557 - RNA, 9876 nt, Artificial Sequence
  derived and/or modified CDS sequence (opt4) from DENV-2__FM210244__SS-prME
accgccggcgugaucaucaugcugauccccaccgccauggccuuccaccugaccaccagaaacggcgagccccacaugaucgugggcagacaggagaagggcaagagccugcuguucaagaccgaggacggcgugaacaugugcacccugauggccaucgaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgcccagagaaucgagaccuggauccugagacaccccggcuucaccaucauggccgccauccuggccuacaccgugggcaccacccacuuccagagagcccugaucuucauccugcuggccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaacgaggagcaggacaagagauucgugugcaagcacagcaugguggacagaggcuggggcaacggcugcggccuguucggcaagggcggcaucgugaccugcgccauguucaccugcaagaagaacauggagggcaagaucgugcagcccgagaaccuggaguacaccaucgugaucaccccccacagcggcgaggagcacgccgugggcaacgacaccggcaagcacggcaaggagaucaagaucaccccccagagccccaucaccgaggccgagcugaccggcuacggcaccgugaccauggagugcagccccagaaccggccuggacuucaacgagauggugcugcugcagauggaggacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagaucgugaaggagaucgccgagacccagcacggcaccaucgugaucagagugcaguacgagggcgacggcagccccugcaagauccccuucgagaucauggaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcgugaucacccuguaccugggcgccauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucaccaccaacaucuggcugaagcugagagagaagcaggacguguucugcgacagcaagcugaugagcgccgccaucaaggacaacagagccgugcacgccgacaugggcuacuggaucgagagcgcccugaacgacaccuggaagauggagaaggccagcuucaucgaggugaagagcugccacuggcccaagagccacacccuguggagcaacggcgugcuggagagcgagaugaucauccccaagagcuucgccggccccgugagccagcacaacuacagacccggcuacuacacccagaccgccggccccuggcaccugggcaagcuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugguggccgugagcuucgugacccugaucaccggcaacaugagcuucagagaccugggcagagugauggugauggugggcgccgccaugaccgacgacaucggcaucggcgugaccuaccuggcccugcuggccgccuucaaggugagacccaccuucgccgccggccugcugcugagaaagcugaccagcaaggagcugaugauggccaccaucggcaucgcccugcugagccagagcaccauccccgagaccauccuggagcugaccgacgcccuggcccugggcaugauggugcugaagaucgugagaaacauggagaaguaccagcuggccgugaccaucauggccaucagcugcgugcccaacgccgugauccugcagaacgccuggaaggugagcugcaccauccuggccaccgugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccaccgacgugaagugggaggaccaggccgagaucagcggcagcagccccauccugagcaucaccaucgccgaggacggcagcaugagcaucaagaacgaggaggaggagcagacccugaccauccugaucagaaccggccugcuggugaucagcggccuguuccccgugagcauccccaucaccgccgccgccugguaccugugggaggugaagaagcagagagccggcgugcugugggacgugcccagccccccccccgugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacagaggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucguggacagaaagggcaagguggugggccuguacggcaacggcguggugaccagaagcggcgccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcaaggaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacagaguggccgccgagggcaucaacuacgccgacagaagauggugcuucgacggcgugaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagagacgcccuggacaaccuggccgugcugcacaccgccgaggccggcggcaaggccuacaaccacgcccugagcgagcugcccgagacccuggagacccugcugcugcugacccugcuggccaccgugaccggcggcaucuuccuguuccugaugagcggcaagggcgugggcaagaugacccugggcaugugcugcaucaucaccgccagcauccugcuguggcacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucgccacccaggagcccgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggaccccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccaucgaggccggcagaacccugagagugcugagccugguggagaacuggcugaacaacgacacccaguucugcaucaaggugcugaaccccuacaugcccagcgugaucgagaagauggagacccugcagagaaaguacggcggcgcccuggugagaaacccccugagcagaaacagcacccacgagauguacugggugagcaacgccaccggcaacaucgugagcagcgugaacaugaucagcagaaugcugaucaacagauucaccaugaagcacaagaaggccaccuacgagcccgacguggaccugggcagcggcaccagaaacaucggcaucgagagcgagaugcccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacguggugcccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcagauucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacauggagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcaucuucaagagcauccagcaccugaccgugaccgaggagaucgccgugcagaacuggcuggccagagugggcagagagagacugagcagaauggccaucagcggcgacgacugcguggugaagccccuggacgacagauucgccagcgcccugaccgcccugaacgacaugggcaaggugagaaaggacauccagcagugggagcccagcagaggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugaaggagaccgccugccugggcaagagcuacgcccagauguggagccugauguacuuccacagaagagaccugagacuggccgccaacgccaucugcagcgccgugcccagccacugggugcccaccagcagaaccaccuggagcauccacgccaagcacgaguggaugaccaccgaggacaugcugaccguguggaacagaguguggauccaggagaaccccuggauggaggacaagacccccguggagagcugggaggaggugcccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 17558 - RNA, 9876 nt, Artificial Sequence
  derived and/or modified CDS sequence (opt4) from DENV-2__FM210234__SS-prME
accgccggcgugaucaucaugcugauccccaccgccauggccuuccaccugaccaccagaaacggcgagccccacaugaucgugggcagacaggagaagggcaagagccugcuguucaagaccgaggacggcgugaacaugugcacccugauggccaucgaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgcccagagaaucgagaccuggauccugagacaccccggcuucaccaucauggccgccauccuggccuacaccgugggcaccacccacuuccagagagcccugaucuucauccugcuggccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaacgaggagcaggacaagagauucgugugcaagcacagcaugguggacagaggcuggggcaacggcugcggccuguucggcaagggcggcaucgugaccugcgccauguucaccugcaagaagaacauggagggcaagaucgugcagcccgagaaccuggaguacaccaucgugaucaccccccacagcggcgaggagcacgccgugggcaacgacaccggcaagcacggcaaggagaucaagaucaccccccagagccccaucaccgaggccgagcugaccggcuacggcaccgugaccauggagugcagccccagaaccggccuggacuucaacgagauggugcugcugcagauggaggacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagaucgugaaggagaucgccgagacccagcacggcaccaucgugaucagagugcaguacgagggcgacggcagccccugcaagauccccuucgagaucauggaccuggagaagagacacgugcugggcagacugaucaccgugaaccccaucgugaccggcaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcgugaucacccuguaccugggcgccauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucaccaccaacaucuggcugaagcugagagagaagcaggacguguucugcgacagcaagcugaugagcgccgccaucaaggacaacagagccgugcacgccgacaugggcuacuggaucgagagcgcccugaacgacaccuggaagauggagaaggccagcuucaucgaggugaagagcugccacuggcccaagagccacacccuguggagcaacggcgugcuggagagcgagaugaucauccccaagagcuucgccggccccgugagccagcacaacuacagacccggcuacuacacccagaccgccggccccuggcaccugggcaagcuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcaucgcccuguuccuggaggagaugcugagaaccagagugggcaccaagcacgccauccugcugguggccgugagcuucgugacccugaucaccggcaacaugagcuucagagaccugggcagagugauggugauggugggcgccgccaugaccgacgacaucggcaugggcgugaccuaccuggcccugcuggccgccuucaaggugagacccaccuucgccgccggccugcugcugagaaagcugaccagcaaggagcugaugauggccaccaucggcaucgcccugcugagccagagcaccauccccgagaccauccuggagcugaccgacgcccuggcccugggcaugauggugcugaagaucgugagaaacauggagaaguaccagcuggccgugaccaucauggccaucagcugcgugcccaacgccgugauccugcagaacgccuggaaggugagcugcaccauccuggccaccgugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccaccgacgugaagugggaggaccaggccgagaucagcggcagcagccccauccugagcaucaccaucgccgaggacggcagcaugagcaucaagaacgaggaggaggagcagacccugaccauccugaucagaaccggccugcuggugaucagcggccuguuccccgugagcauccccaucaccgccgccgccugguaccugugggaggugaagaagcagagagccggcgugcugugggacgugcccagccccccccccgugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacagaggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucguggacagaaagggcaagguggugggccuguacggcaacggcguggugaccagaagcggcgccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacagaguggccgccgagggcaucaacuacgccgacagaagauggugcuucgacggcgugaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagagacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcgugggcaagaugacccugggcaugugcugcaucaucaccgccagcauccugcuguggcacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucgccacccaggagcccgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggaccccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccaucgaggccggcagaacccugagagugcugagccugguggagaacuggcugaacaacgacacccaguucugcaucaaggugcugaaccccuacaugcccagcgugaucgagaagauggagacccugcagagaaaguacggcggcgcccuggugagaaacccccugagcagaaacagcacccacgagauguacugggugagcaacgccaccggcaacaucgugagcagcgugaacaugaucagcagaaugcugaucaacagauucaccaugaagcacaagaaggccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacguggugcccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcagauucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacauggagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcaucuucaagagcauccagcaccugaccgugaccgaggagaucgccgugcagaacuggcuggccagagugggcagagagagacugagcagaauggccaucagcggcgacgacugcguggugaagccccuggacgacagauucgccagcgcccugaccgcccugaacgacaugggcaaggugagaaaggacauccagcagugggagcccagcagaggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugaaggagaccgccugccugggcaagagcuacgcccagauguggagccugauguacuuccacagaagagaccugagacuggccgccaacgccaucugcagcgccgugcccagccacugggugcccaccagcagaaccaccuggagcauccacgccaagcacgaguggaugaccaccgaggacaugcugaccguguggaacagaguguggauccaggagaaccccuggauggaggacaagacccccguggagagcugggaggaggugcccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 17559 - RNA, 9876 nt, Artificial Sequence
  derived and/or modified CDS sequence (opt4) from DENV-2__FM210213__SS-prME
accgccggcgugaucaucaugcugauccccaccgccauggccuuccaccugaccaccagaaacggcgagccccacaugaucgugggcagacaggagaagggcaagagccugcuguucaagaccgaggacggcgugaacaugugcacccugauggccaucgaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgcccagagaaucgagaccuggauccugagacaccccggcuucaccaucauggccgccauccuggccuacaccgugggcaccacccacuuccagagagcccugaucuucauccugcuggccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaacgaggagcaggacaagagauucgugugcaagcacagcaugguggacagaggcuggggcaacggcugcggccuguucggcaagggcggcaucgugaccugcgccauguucaccugcaagaagaacauggagggcaagaucgugcagcccgagaaccuggaguacaccaucgugaucaccccccacagcggcgaggagcacgccgugggcaacgacaccggcaagcacggcaaggagaucaagaucaccccccagagccccaucaccgaggccgagcugaccggcuacggcaccgugaccauggagugcagccccagaaccggccuggacuucaacgagauggugcugcugcagauggaggacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagaucgugaaggagaucgccgagacccagcacggcaccaucgugaucagagugcaguacgagggcgacggcagccccugcaagauccccuucgagaucauggaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcgugaucacccuguaccugggcgccauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucaccaccaacaucuggcugaagcugagagagaagcaggacguguucugcgacagcaagcugaugagcgccgccaucaaggacaacagagccgugcacgccgacaugggcuacuggaucgagagcgcccugaacgacaccuggaagauggagaaggccagcuucaucgaggugaagagcugccacuggcccaagagccacacccuguggagcaacggcgugcuggagagcgagaugaucauccccaagagcuucgccggccccgugagccagcacaacuacagacccggcuacuacacccagaccgccggccccuggcaccugggcaagcuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugguggccgugagcuucgugacccugaucaccggcaacaugagcuucagagaccugggcagagugauggugauggugggcgccgccaugaccgacgacaucggcaugggcgugaccuaccuggcccugcuggccgccuucaaggugagacccaccuucgccgccggccugcugcugagaaagcugaccagcaaggagcugaugauggccaccaucggcaucgcccugcugagccagagcaccauccccgagaccauccuggagcugaccgacgcccuggcccugggcaugauggugcugaagaucgugagaaacauggagaaguaccagcuggccgugaccaucauggccaucagcugcgugcccaacgccgugauccugcagaacgccuggaaggugagcugcaccauccuggccaccgugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccaccgacgugaagugggaggaccaggccgagaucagcggcagcagccccauccugagcaucaccaucgccgaggacggcagcaugagcaucaagaacgaggaggaggagcagacccugaccauccugaucagaaccggccugcuggugaucagcggccuguuccccgugagcauccccaucaccgccgccgccugguaccugugggaggugaagaagcagagagccggcgugcugugggacgugcccagccccccccccgugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacagaggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucguggacagaaagggcaagguggugggccuguacggcaacggcguggugaccagaagcggcgccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacagaguggccgccgagggcaucaacuacgccgacagaagauggugcuucgacggcgugaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagaaacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcgugggcaagaugacccugggcaugugcugcaucaucaccgccagcauccugcuguggcacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucgccacccaggagcccgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggaccccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccaucgaggccggcagaacccugagagugcugagccugguggagaacuggcugaacaacgacacccaguucugcaucaaggugcugaaccccuacaugcccagcgugaucgagaagauggagacccugcagagaaaguacggcggcgcccuggugagaaacccccugagcagaaacagcacccacgagauguacugggugagcaacgccaccggcaacaucgugagcagcgugaacaugaucagcagaaugcugaucaacagauucaccaugaagcacaagaaggccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacguggugcccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcagauucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacauggagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcaucuucaagagcauccagcaccugaccgugaccgaggagaucgccgugcagaacuggcuggccagagugggcagagagagacugagcagaauggccaucagcggcgacgacugcguggugaagccccuggacgacagauucgccagcgcccugaccgcccugaacgacaugggcaaggugagaaaggacauccagcagugggagcccagcagaggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugaaggagaccgccugccugggcaagagcuacgcccagauguggagccugauguacuuccacagaagagaccugagacuggccgccaacgccaucugcagcgccgugcccagccacugggugcccaccagcagaaccaccuggagcauccacgccaagcacgaguggaugaccaccgaggacaugcugaccguguggaacagaguguggauccaggagaaccccuggauggaggacaagacccccguggagagcugggaggaggugcccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 17560 - RNA, 9876 nt, Artificial Sequence
  derived and/or modified CDS sequence (opt4) from DENV-2__FM210235__SS-prME
accgccggcgugaucaucaugcugauccccaccgccauggccuuccaccugaccaccagaaacggcgagccccacaugaucgugggcagacaggagaagggcaagagccugcuguucaagaccgaggacggcgugaacaugugcacccugauggccaucgaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgcccagagaaucgagaccuggauccugagacaccccggcuucaccaucauggccgccauccuggccuacaccgugggcaccacccacuuccagagagcccugaucuucauccugcuggccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaacgaggagcaggacaagagauucgugugcagacacagcaugguggacagaggcuggggcaacggcugcggccuguucggcaagggcggcaucgugaccugcgccauguucaccugcaagaagaacauggagggcaagaucgugcagcccgagaaccuggaguacaccaucgugaucaccccccacagcggcgaggagcacgccgugggcaacgacaccggcaagcacggcaaggagaucaagaucaccccccagagccccaucaccgaggccgagcugaccggcuacggcaccgugaccauggagugcagccccagaaccggccuggacuucaacgagauggugcugcugcagauggaggacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagaucgugaaggagaucgccgagacccagcacggcaccaucgugaucagagugcaguacgagggcgacggcagccccugcaagauccccuucgagaucauggaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcgugaucacccuguaccugggcgccauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucaccaccaacaucuggcugaagcugagagagaagcaggacguguucugcgacagcaagcugaugagcgccgccaucaaggacaacagagccgugcacgccgacaugggcuacuggaucgagagcgcccugaacgacaccuggaagauggagaaggccagcuucaucgaggugaagagcugccacuggcccaagagccacacccuguggagcaacggcgugcuggagagcgagaugaucauccccaagagcuucgccggccccgugagccagcacaacuacagacccggcuacuacacccagaccgccggccccuggcaccugggcaagcuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcuggugaccgugagcuucgugacccugaucaccggcaacaugagcuucagagaccugggcagagugauggugauggugggcgccgccaugaccgacgacaucggcaugggcgugaccuaccuggcccugcuggccgccuucaaggugagacccaccuucgccgccggccugcugcugagaaagcugaccagcaaggagcugaugauggccaccaucggcaucgcccugcugagccagagcaccauccccgagaccauccuggagcugaccgacgcccuggcccugggcaugauggugcugaagaucgugagaaacauggagaaguaccagcuggccgugaccaucauggccaucagcugcgugcccaacgccgugauccugcagaacgccuggaaggugagcugcaccauccuggccgccgugagcgugagcccccugcugcugaccagcagccagcagaaggccgacuggaucccccuggaguggagcaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccaccgacgugaagugggaggaccaggccgagaucagcggcagcagccccauccugagcaucaccaucgccgaggacggcagcaugagcaucaagaacgaggaggaggagcagacccugaccauccugaucagaaccggccugcuggugaucagcggccuguuccccgugagcauccccaucaccgccgccgccugguaccugugggaggugaagaagcagagagccggcgugcugugggacgugcccagccccccccccgugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacagaggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucguggacagaaagggcaagguggugggccuguacggcaacggcguggugaccagaagcggcgccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacagaguggccgccgagggcaucaacuacgccgacagaagauggugcuucgacggcgugaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagagacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcgugggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucgccaccagagagcccgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcgugaccgugaucgaccuggaccccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccaucgaggccggcagaacccugagagugcugagccugguggagaacuggcugaacaacgacacccaguucugcaucaaggugcugaaccccuacaugcccagcgugaucgagaagauggagacccugcagagaaaguacggcggcgcccuggugagaaacccccugagcagaaacagcacccacgagauguacugggugagcaacgccaccggcaacaucgugagcagcgugaacaugaucagcagaaugcugaucaacagauucaccaugaagcacaagaaggccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacguggugcccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcagauucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacauggagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcguguucaagagcauccagagacugaccgugaccgaggagaucgccgugcagaacuggcuggccagagugggcagagagagacugagcagaauggccaucagcggcgacgacugcguggugaagccccuggacgacagauucgccagcgcccugaccgcccugaacgacaugggcaaggugagaaaggacauccagcagugggagcccagcagaggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugaaggagaccgccugccugggcaagagcuacgcccagauguggagccugauguacuuccacagaagagaccugagacuggccgccaacgccaucugcagcgccgugcccagccacugggugcccaccagcagaaccaccuggagcauccacgccaagcacgaguggaugaccaccgaggacaugcugaccguguggaacagaguguggauccaggagaaccccuggauggaggacaagacccccguggagagcugggaggaggugcccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 17561 - RNA, 9876 nt, Artificial Sequence
  derived and/or modified CDS sequence (opt4) from DENV-2__FM210205__SS-prME
agcgccggcaugaucaucaugcugauccccaccgugauggccuuccaccugaccaccagaaacggcgagccccacaugaucgugggcauccaggagaagggcaagagccugcuguucaagaccgaggacggcgugaacaugugcacccugauggccauggaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgcccagagaaucgagaccuggauccugagacaccccggcuucaccaucauggccgccauccuggccuacaccaucggcaccacccacuuccagagagugcugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaaggaggagcaggacaagagauucgugugcaagcacagcaugguggacagaggcuggggcaacggcugcggccuguucggcaagggcggcaucgugaccugcgccauguucaccugcaagaagaacauggagggcaagaucgugcagcccgagaaccuggaguacaccaucguggugaccccccacagcggcgaggagcacgccgugggcaacgacaccggcaagcacggcaaggagaucaaggugaccccccagagcagcaucaccgaggccgagcugaccggcuacggcaccgugaccauggagugcagccccagaaccggccuggacuucaacgagauggugcugcugcagauggagaacaaggccuggcuggugcacagacagugguuccuggaccugccccugcccuggcugcccggcgccgacaagcaggagagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucgugaucagagugcaguacgagggcgacggcagccccugcaagauccccuucgagaucauggaccuggagaagagauacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcaucgugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccaggaggagggcaucugcggcaucagaagcgugaccagacuggagaaccugauguggaagcagaucacccccgagcugaaccacauccuggccgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagcuacaaccagaccuuccugaucgacggccccgagaccgccgagugccccaacaccaacagagccuggaacagccuggagguggaggacuacggcuucggcguguucaccaccaacaucuggcugaagcugaaggagaagcaggacgccuucugcgacagcaagcugaugagcgccgccaucaaggacaacagagccgugcacgccgacaugggcuacuggaucgagagcgcccugaacgacaccuggaagaucgagaaggccagcuucaucgaggugaagaacugccacuggcccaagagccacacccuguggagcaacggcgugcuggagagcgagaugaucauccccaagaaccuggccggccccgugagccagcacaacuacagacccggcuaccacacccagaucgccggccccuggcaccugggcaagcuggagauggacuucgacuucugcgacggcaccaccgugaucgugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagguggacaacuucagccugggcgugcugggcauggcccuguuccuggaggagaugcugagaaccagagugggcaccaagcacgccauccugcugguggccgugagcuucgugacccugaucaccggcaacaugagcuucaaggaccugggcagagugguggugauggugggcgccaccauggccgacgacaucggcaugggcgugaccuaccuggcccugcuggccgccuucaaggugagacccaccuucgccgccggccugcugcugaagaagcugaccagcaaggagcugaugaugaccaccaucggcaucgugcugcugagccagagcaccauccccgagaccgugcuggagcugaccgacgcccuggcccugggcaugauggugcugaagaucgugagaaacauggagaaguaccagcuggccgugaccaucauggccauccugugcgugcccaacgccgugauccugcagaacgccuggaaggugagcugcaccauccuggccguggugagcgugagcccccugcugcugaccagcagccagcagaagaccgacuggaucccccuggcccugaccaucaagggccugaaccccaccgccaucuuccugaccacccugagcagaaccaacaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccaccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggccuguuccccaucagcauccccaucaccgccgccgccugguaccugugggaggugaagaagcagagagccggcgugcugugggacgugcccagccccccccccaugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacaagggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucaucgacaagaagggcaagguggugggccuguacggcaacggcguggugaccagaagcggcgccuacgugagcgccaucgcccagaccgagaagagcaucgaggacaaccccgagaucgaggacgacaucuucagaaagagaagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucaucgacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaagauggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaagaccagagacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcagaggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggacuucggccugggcagcaucgccacccagcagcccgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggaccccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaucccccccgagaagugcgacacccugcugugcgacaucggcgagagcagccccaaccccaccguggaggccggcagaacccugagagugcugaaccugguggagaacuggcugaacaacaacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccagcggcaacaucgugagcagcgugaacaugaucagcagaaugcugaucaacagauucaccaugagacacaagaaggccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacgugcugcccaccgugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcagauucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacauggagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcguguucaagaacauccagcaccugaccgugaccgaggagguggccgugcagaacuggcuggccagagugggcagagagagacugagcagaauggccaucagcggcgacgacugcguggugaagccccuggacgacagauucgccaacgcccugaccgcccugaacgacaugggcaagaucagaaaggacauccagcagugggagcccagcaagggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugagagagaccgccugccugggcaagagcuacgcccagauguggagccugauguacuuccacagaagagaccugagacuggccgccaacgccaucugcagcgccgugcccagccacugggugcccaccagcagaaccaccuggagcauccacgccaagcacgaguggaugaccaccgaggacaugcugaccguguggaacagaguguggaucagagagaaccccuggauggaggacaagacccccguggagagcugggaggagauccccuaccugggcaagagagaggaccaguggugcggcagccugaucggccugaccagcagagccaccugggccaagaacauccaggccgccaucaaccaggugagaagccugaucggcaacgaggaguacaccgacuacaugcccagcaugaagagauucagaagagaggaggaggaggccggcgugcugugguga

SEQ ID NO: 17562 - RNA, 9876 nt, Artificial Sequence
  derived and/or modified CDS sequence (opt4) from DENV-2__FM210206__SS-prME
agcgccggcaugaucaucaugcugauccccaccgugauggccuuccaccugaccaccagaaacggcgagccccacaugaucgugggcauccaggagaagggcaagagccugcuguucaagaccgaggacggcgugaacaugugcacccugauggccauggaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgcccagagaaucgagaccuggauccugagacaccccggcuucacccugauggccgccauccuggccuacaccaucggcaccacccacuuccagagagugcugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaaggaggagcaggacaagagauucgugugcaagcacagcaugguggacagaggcuggggcaacggcugcggccuguucggcaagggcggcaucgugaccugcgccauguucaccugcaagaagaacauggagggcaagaucgugcagcccgagaaccuggaguacaccaucguggugaccccccacagcggcgaggagcacgccgugggcaacgacaccggcaagcacggcaaggagaucaaggugaccccccagagcagcaucaccgaggccgagcugaccggcuacggcaccgugaccauggagugcagccccagaaccggccuggacuucaacgagauggugcugcugcagauggagaacaaggccuggcuggugcacagacagugguuccuggaccugccccugcccuggcugcccggcgccgacaagcaggagagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucgugaucagagugcaguacgagggcgacggcagccccugcaagauccccuucgagaucauggaccuggagaagagauacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcaucgugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccaggaggagggcaucugcggcaucagaagcgugaccagacuggagaaccugauguggaagcagaucacccccgagcugaaccacauccuggccgagaacgaggugaagcugaccaucaugaccggcgacaucaagggcaucaugcaggccggcaagagaagccugagaccccagcccaccgagcugaaguacagcuggaagaccuggggcaaggccaagaugcugagcaucgagagcuacaaccagaccuuccugaucgacggccccgagaccgccgagugccccaacaccaacagagccuggaacagccuggagguggaggacuacggcuucggcguguucaccaccaacaucuggcugaagcugaaggagaagcaggacgccuucugcgacagcaagcugaugagcgccgccaucaaggacaacagagccgugcacgccgacaugggcuacuggaucgagagcgcccugaacgacaccuggaagaucgagaaggccagcuucaucgaggugaagaacugccacuggcccaagagccacacccuguggagcaacggcgugcuggagagcgagaugaucauccccaagaaccuggccggccccgugagccagcacaacuacagacccggcuaccacacccagaucgccggccccuggcaccugggcaagcuggagauggacuucgacuucugcgacggcaccaccgugaucgugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagguggacaacuucagccugggcgugcugggcauggcccuguuccuggaggagaugcugagaaccagagugggcaccaagcacgccauccugcugguggccgugagcuucgugacccugaucaccggcaacaugagcuucaaggaccugggcagagugguggugauggugggcgccaccauggccgacgacaucggcaugggcgugaccuaccuggcccugcuggccgccuucaaggugagacccaccuucgccgccggccugcugcugagaaagcugaccagcaaggagcugaugaugaccaccaucggcaucgugcugcugagccagagcaccauccccgagaccgugcuggagcugaccgacgcccuggcccugggcaugauggugcugaagaucgugagaaacauggagaaguaccagcuggccgugaccaucauggccauccugugcgugcccaacgccgugauccugcagaacgccuggaaggugagcugcaccauccuggccguggugagcgugagcccccugcugcugaccagcagccagcagaagaccgacuggaucccccuggcccugaccaucaagggccugaaccccaccgccaucuuccugaccacccugagcagaaccaacaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccaccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggccuguuccccaucagcauccccaucaccgccgccgccugguaccugugggaggugaagaagcagagagccggcgugcugugggacgugcccagccccccccccaugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacaagggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucaucgacaagaagggcaagguggugggccuguacggcaacggcguggugaccagaagcggcgccuacgugagcgccaucgcccagaccgagaagagcaucgaggacaaccccgagaucgaggacgacaucuucagaaagagaagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucaucgacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaagauggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaagaccagagacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcagaggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucgccacccagcagcccgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggaccccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaugggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaucccccccgagaagugcgacacccugcugugcgacaucggcgagagcagccccaaccccaccguggaggccggcagaacccugagagugcugaaccugguggagaacuggcugaacaacaacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccagcggcaacaucgugagcagcgugaacaugaucagcagaaugcugaucaacagauucaccaugagacacaagaaggccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacgugcugcccaccgugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcagauucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacauggagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcguguucaagaacauccagcaccugaccgugaccgaggagguggccgugcagaacuggcuggccagagugggcagagagagacugagcagaauggccaucagcggcgacgacugcguggugaagccccuggacgacagauucgccaacgcccugaccgcccugaacgacaugggcaagaucagaaaggacauccagcagugggagcccagcaagggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugagagagaccgccugccugggcaagagcuacgcccagauguggagccugauguacuuccacagaagagaccugagacuggccgccaacgccaucugcagcgccgugcccagccacugggugcccaccagcagaaccaccuggagcauccacgccaagcacgaguggaugaccaccgaggacaugcugaccguguggaacagaguguggaucagagagaaccccuggauggaggacaagacccccguggagagcugggaggagauccccuaccugggcaagagagaggaccaguggugcggcagccugaucggccugaccagcagagccaccugggccaagaacauccaggccgccaucaaccaggugagaagccugaucggcaacgaggaguacaccgacuacaugcccagcaugaagagauucagaagagaggaggaggaggccggcgugcugugguga

SEQ ID NO: 17563 - RNA, 9876 nt, Artificial Sequence
  derived and/or modified CDS sequence (opt4) from DENV-2__FM210246__SS-prME
agcgccggcaugaucaucaugcugauccccaccgugauggccuuccaccugaccaccagaaacggcgagccccacaugaucgugggcauccaggagaagggcaagagccugcuguucaagaccgaggacggcgugaacaugugcacccugauggccauggaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgcccagagaaucgagaccuggauccugagacaccccggcuucaccaucauggccgccauccuggccuacaccaucggcaccacccacuuccagagagugcugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaaggaggagcaggacaagagauucgugugcaagcacagcaugguggacagaggcuggggcaacggcugcggccuguucggcaagggcggcaucgugaccugcgccauguucaccugcaagaagaacauggagggcaagaucgugcagcccgagaaccuggaguacaccaucguggugaccccccacagcggcgaggagcacgccgugggcaacgacaccggcaagcacggcaaggagaucaaggugaccccccagagcagcaucaccgaggccgagcugaccggcuacggcaccgugaccauggagugcagccccagaaccggccuggacuucaacgagauggugcugcugcagauggagaacaaggccuggcuggugcacagacagugguuccuggaccugccccugcccuggcugcccggcgccgacaagcaggagagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucgugaucagagugcaguacgagggcgacggcagccccugcaagauccccuucgagaucauggaccuggagaagagauacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcaucgugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccaggaggagggcaucugcggcaucagaagcgugaccagacuggagaaccugauguggaagcagaucacccccgagcugaaccacauccuggccgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagcuucaaccagaccuuccugaucgacggccccgagaccgccgagugccccaacaccaacagagccuggaacagccuggagguggaggacuacggcuucggcguguucaccaccaacaucuggcugaagcugaaggagaagcaggacgccuucugcgacagcaagcugaugagcgccgccaucaaggacaacagagccgugcacgccgacaugggcuacuggaucgagagcgcccugaacgacaccuggaagaucgagaaggccagcuucaucgaggugaagaacugccacuggcccaagagccacacccuguggagcaacggcgugcuggagagcgagaugaucauccccaagaaccuggccggccccgugagccagcacaacuacagacccggcuaccacacccagaucgccggccccuggcaccugggcaagcuggagauggacuucgacuucugcgacggcaccaccgugaucgugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagguggacaacuucagccugggcgugcugggcauggcccuguuccuggaggagaugcugagaaccagagugggcaccaagcacgccauccugcugguggccgugagcuucgugacccugaucaccggcaacaugagcuucaaggaccugggcagagugguggugauggugggcgccaccauggccgacgacaucggcaugggcgugaccuaccuggcccugcuggccgccuucaaggugagacccaccuucgccgccggccugcugcugagaaagcugaccagcaaggagcugaugaugaccaccaucggcaucgugcugcugagccagagcaccauccccgagaccgugcuggagcugaccgacgcccuggcccugggcaugauggugcugaagaucgugagaaacauggagaaguaccagcuggccgugaccaucauggccauccugugcgugcccaacgccgugauccugcagaacgccuggaaggugagcugcaccauccuggccguggugagcgugagcccccugcugcugaccagcagccagcagaagaccgacuggaucccccuggcccugaccaucaagggccugaaccccaccgccaucuuccugaccacccugagcagaaccaacaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccaccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggccuguuccccaucagcauccccaucaccgccgccgccugguaccugugggaggugaagaagcagagagccggcgugcugugggacgugcccagccccccccccaugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacaagggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucaucgacaagaagggcaagguggugggccuguacggcaacggcguggugaccagaagcggcgccuacgugagcgccaucgcccagaccgagaagagcaucgaggacaaccccgagaucgaggacgacaucuucagaaagagaagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucaucgacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaagauggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaagaccagagacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcagaggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucgccacccagcagcccgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggaccccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaugggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaucccccccgagaagugcgacacccugcugugcgacaucggcgagagcagccccaaccccaccguggaggccggcagaacccugagagugcugaaccugguggagaacuggcugaacaacaacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccagcggcaacaucgugagcagcgugaacaugaucagcagaaugcugaucaacagauucaccaugagacacaagaaggccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacgugcugcccaccgugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcagauucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacauggagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcguguucaagaacauccagcaccugaccgugaccgaggagguggccgugaagaacuggcuggccagagugggcagagagagacugagcagaauggccaucagcggcgacgacugcguggugaagccccuggacgacagauucgccaacgcccugaccgcccugaacgacaugggcaagaucagaaaggacauccagcagugggagcccagcaagggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugagagagaccgccugccugggcaagagcuacgcccagauguggagccugauguacuuccacagaagagaccugagacuggccgccaacgccaucugcagcgccgugcccagccacugggugcccaccagcagaaccaccuggagcauccacgccaagcacgaguggaugaccaccgaggacaugcugaccguguggaacagaguguggaucagagagaaccccuggauggaggacaagacccccguggagagcugggaggagauccccuaccugggcaagagagaggaccaguggugcggcagccugaucggccugaccagcagagccaccugggccaagaacauccaggccgccaucaaccaggugagaagccugaucggcaacgaggaguacaccgacuacaugcccagcaugaagagauucagaagagaggaggaggaggccggcgugcugugguga

SEQ ID NO: 17564 - RNA, 9876 nt, Artificial Sequence
  derived and/or modified CDS sequence (opt4) from DENV-2__FM210207__SS-prME
agcgccggcaugaucaucaugcugauccccaccgugauggccuuccaccugaccaccagaaacggcgagccccacaugaucgugggcauccaggagaagggcaagagccugcuguucaagaccgaggacggcgugaacaugugcacccugauggccauggaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgcccagagaaucgagaccuggauccugagacaccccggcuucaccaucauggccgccauccuggccuacaccaucggcaccacccacuuccagagagugcugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaaggaggagcaggacaagagauucgugugcaagcacagcaugguggacagaggcuggggcaacggcugcggccuguucggcaagggcggcaucgugaccugcgccauguucaccugcaagaagaacauggagggcaagaucgugcagcccgagaaccuggaguacaccaucguggugaccccccacagcggcgaggagcacgccgugggcaacgacaccggcaagcacggcaaggagaucaaggugaccccccagagcagcaucaccgaggccgagcugaccggcuacggcaccgugaccauggagugcagccccagaaccggccuggacuucaacgagauggugcugcugcagauggagaacaaggccuggcuggugcacagacagugguuccuggaccugccccugcccuggcugcccggcgccgacaagcaggagagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucgugaucagagugcaguacgagggcgacggcagccccugcaagauccccuucgagaucauggaccuggagaagagauacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcaucgugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccaggaggagggcaucugcggcaucagaagcgugaccagacuggagaaccugauguggaagcagaucacccccgagcugaaccacauccuggccgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagcuacaaccagaccuuccugaucgacggccccgagaccgccgagugccccaacaccaacagagccuggaacagccuggagguggaggacuacggcuucggcguguucaccaccaacaucuggcugaagcugaaggagaagcaggacgccuucugcgacagcaagcugaugagcgccgccaucaaggacaacagagccgugcacgccgacaugggcuacuggaucgagagcgcccugaacgacaccuggaagaucgagaaggccagcuucaucgaggugaagaacugccacuggcccaagagccacacccuguggagcaacggcgugcuggagagcgagaugaucauccccaagaaccuggccggccccgugagccagcacaacuacagacccggcuaccacacccagaucgccggccccuggcaccugggcaagcuggagauggacuucgacuucugcgacggcaccaccgugaucgugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagguggacaacuucagccugggcgugcugggcauggcccuguuccuggaggagaugcugagaaccagagugggcaccaagcacgccauccugcugguggccgugagcuucgugacccugaucaccggcaacaugagcuucaaggaccugggcagagugguggugauggugggcgccaccauggccgacgacaucggcaugggcgugaccuaccuggcccugcuggccgccuucaaggugagacccaccuucgccgccggccugcugcugagaaagcugaccagcaaggagcugaugaugaccaccaucggcaucgugcugcugagccagagcaccauccccgagaccgugcuggagcugaccgacgcccuggcccugggcaugauggugcugaagaucgugagaaacauggagaaguaccagcuggccgugaccaucauggccauccugugcgugcccaacgccgugauccugcagaacgccuggaaggugagcugcaccauccuggccguggugagcgugagcccccugcugcugaccagcagccagcagaagaccgacuggaucccccuggcccugaccaucaagggccugaaccccaccgccaucuuccugaccacccugagcagaaccaacaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccaccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggccuguuccccaucagcauccccaucaccgccgccgccugguaccugugggaggugaagaagcagagagccggcgugcugugggacgugcccagccccccccccaugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacaagggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucaucgacaagaagggcaagguggugggccuguacggcaacggcguggugaccagaagcggcgccuacgugagcgccaucgcccagaccgagaagagcaucgaggacaaccccgagaucgaggacgacaucuucagaaagagaagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucaucgacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaagauggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaagaccagagacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcagaggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucgccacccagcagcccgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggaccccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaugggcgagacccugggcgagaaguggaagagcagacugaacgcccugggcaagaacgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaucccccccgagaagugcgacacccugcugugcgacaucggcgagagcagccccaaccccaccguggaggccggcagaacccugagagugcugaaccugguggagaacuggcugaacaacaacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccagcggcaacaucgugagcagcgugaacaugaucagcagaaugcugaucaacagauucaccaugagacacaagaaggccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacgugcugcccaccgugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcagauucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacauggagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcguguucaagaacauccagcaccugaccgugaccgaggagguggccgugcagaacuggcuggccagagugggcagagagagacugagcagaauggccaucagcggcgacgacugcguggugaagccccuggacgacagauucgccaacgcccugaccgcccugaacgacaugggcaagaucagaaaggacauccagcagugggagcccagcaagggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugagagagaccgccugccugggcaagagcuacgcccagauguggagccugauguacuuccacagaagagaccugagacuggccgccaacgccaucugcagcgccgugcccagccacugggugcccaccagcagaaccaccuggagcaugcacgccaagcacgaguggaugaccaccgaggacaugcugaccguguggaacagaguguggaucagagagaaccccuggauggaggacaagacccccguggagagcugggaggagauccccuaccugggcaagagagaggaccaguggugcggcagccugaucggccugaccagcagagccaccugggccaagaacauccaggccgccaucaaccaggugagaagccugaucggcaacgaggaguacaccgacuacaugcccagcaugaagagauucagaagagaggaggaggaggccggcgugcugugguga

SEQ ID NO: 17565 - RNA, 9876 nt, Artificial Sequence
  derived and/or modified CDS sequence (opt4) from DENV-2__FM210238__SS-prME
accgccggcaugaucaucaugcugauccccaccgccauggccuuccaccugaccaccagaaacggcgagccccacaugaucgugggcagacaggagaagggcaagagccugcuguucaagaccgaggacggcgugaacaugugcacccugauggccaucgaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgcccagagaaucgagaccuggauccugagacaccccggcuucaccaucauggccgccauccuggccuacaccgugggcaccacccacuuccagagagcccugaucuucauccugcuggccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaacgaggagcaggacaagagauucgugugcaagcacagcaugguggacagaggcuggggcaacggcugcggccuguucggcaagggcggcaucgugaccugcgccauguucaccugcaagaagaacauggagggcaagaucgugcagcccgagaaccuggaguacaccaucgugaucaccccccacagcggcgaggagcacgccgugggcaacgacaccggcaagcacggcaaggagaucaagaucaccccccagagccccaucaccgaggccgagcugaccggcuacggcaccgugaccauggagugcagccccagaaccggccuggacuucaacgagauggugcugcugcagauggaggacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagaucgugaaggagaucgccgagacccagcacggcaccaucgugaucagagugcaguacgagggcgacggcagccccugcaagauccccuucgagaucauggaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcgugaucacccuguaccugggcgccauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucaccaccaacaucuggcugaagcugagagagaagcaggacguguucugcgacagcaagcugaugagcgccgccaucaaggacaacagagccgugcacgccgacaugggcuacuggaucgagagcgcccugaacgacaccuggaagauggagaaggccagcuucaucgaggugaagagcugccacuggcccaagagccacacccuguggagcaacggcgugcuggagagcgagaugaucauccccaagagcuucgccggccccgugagccagcacaacuacagacccggcuacuacacccagaccgccggccccuggcaccugggcaagcuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcuggugaccgugagcuucgugacccugaucaccggcaacaugagcuucagagaccugggcagagugauggugauggugggcgccgccaugaccgacgacaucggcaugggcgugaccuaccuggcccugcuggccgccuucaaggugagacccaccuucgccgccggccugcugcugagaaagcugaccagcaaggagcugaugauggccaccaucggcaucgcccugcugagccagagcaccauccccgagaccauccuggagcugaccgacgcccuggcccugggcaugauggugcugaagaucgugagaaacauggagaaguaccagcuggccgugaccaucauggccaucagcugcgugcccaacgccgugauccugcagaacgccuggaaggugagcugcaccauccuggccgccgugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccaccgacgugaagugggaggaccaggccgagaucagcggcagcagccccauccugagcaucaccaucgccgaggacggcagcaugagcaucaagaacgaggaggaggagcagacccugaccauccugaucagaaccggccugcuggugaucagcggccuguuccccgugagcauccccaucaccgccgccgccugguaccugugggaggugaagaagcagagagccggcgugcugugggacgugcccagccccccccccgugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacagaggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucguggacagaaagggcaagguggugggccuguacggcaacggcguggugaccagaagcggcgccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacagaguggccgccgagggcaucaacuacgccgacagaagauggugcuucgacggcgugaagaacgaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagagacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcgugggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucgccacccaggagcccgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggaccccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccaucgaggccggcagaacccugagagugcugagccugguggagaacuggcugaacaacgacacccaguucugcaucaaggugcugaaccccuacaugcccagcgugaucgagaagauggagacccugcagagaaaguacggcggcgcccuggugagaaacccccugagcagaaacagcacccacgagauguacugggugagcaacgccaccggcaacaucgugagcagcgugaacaugaucagcagaaugcugaucaacagauucaccaugaagcacaagaaggccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacguggugcccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcagauucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacauggagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcguguucaagagcauccagagacugaccgugaccgaggagaucgccgugcagaacuggcuggccagagugggcagagagagacugagcagaauggccaucagcggcgacgacugcguggugaagccccuggacgacagauucgccagcgcccugaccgcccugaacgacaugggcaaggugagaaaggacauccagcagugggagcccagcagaggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugaaggagaccgccugccugggcaagagcuacgcccagauguggagccugauguacuuccacagaagagaccugagacuggccgccaacgccaucugcagcgccgugcccagccacugggugcccaccagcagaaccaccuggagcauccacgccaagcacgaguggaugaccaccgaggacaugcugaccguguggaacagaguguggauccaggagaaccccuggauggaggacaagacccccguggagagcugggaggaggugcccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 17566 - RNA, 9876 nt, Artificial Sequence
  derived and/or modified CDS sequence (opt4) from DENV-2__FM210224__SS-prME
accgccggcgugaucaucaugcugauccccaccgccauggccuuccaccugaccaccagaaacggcgagccccacaugaucgugggcagacaggagaagggcaagagccugcuguucaagaccgaggacggcgugaacaugugcacccugauggccaucgaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgcccagagaaucgagaccuggauccugagacaccccggcuucaccaucauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaacgaggagcaggacaagagauucgugugcaagcacagcaugguggacagaggcuggggcaacggcugcggccuguucggcaagggcggcaucgugaccugcgccauguucaccugcaagaagaacauggagggcaagaucgugcagcccgagaaccuggaguacaccaucgugaucaccccccacagcggcgaggagcacgccgugggcaacgacaccggcaagcacggcaaggagaucaagaucaccccccagagcagcaucaccgaggccgagcugaccggcuacggcaccgugaccauggagugcagccccagaaccggccuggacuucaacgagauggugcugcugcagauggaggacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagaucgugaaggagaucgccgagacccagcacggcaccaucgugaucagagugcaguacgagggcgacggcagccccugcaagauccccuucgagaucauggaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgccaucaucaccuggaucggcaugaacagcagaagcaccagccugagcgugagccuggugcuggugggcgugaucacccuguaccugggcgccauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucaccaccaacaucuggcugaagcugagagagaagcaggacguguucugcgacagcaagcugaugagcgccgccaucaaggacaacagagccgugcacgccgacaugggcuacuggaucgagagcgcccugaacgacaccuggaagauggagaaggccagcuucaucgaggugaagagcugccacuggcccaagagccacacccuguggagcaacggcgugcuggagagcgagaugaucauccccaagagcuucgccggccccgugagccagcacaacuacagacccggcuacuacacccagaccgccggccccuggcaccugggcaagcuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugauggccaccaucggcaucgcccugcugagccagagcaccauccccgagaccauccuggagcugaccgacgcccuggcccugggcaugauggugcugaagaucgugagaaacauggagaaguaccagcuggccgugaccaucauggccaucagcugcgugcccaacgccgugauccugcagaacgccuggaaggugagcugcaccauccuggccgccgugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccaccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggccuguuccccgugagcauccccaucaccgccgccgccugguaccugugggaggugaagaagcagagagccggcgugcugugggacgugcccagccccccccccgugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacagaggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucguggacagaaagggcaagguggugggccuguacggcaacggcguggugaccagaagcggcgccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucaucgacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacagaguggccgccgagggcaucaacuacgccgacagaagauggugcuucgacggcgccaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagagacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcgugggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucgccacccaggagcccgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugaucgcccacuacgccaucaucggccccggccugcaggccaaggccaccagagaggcccagaagagagccgccgccggcaucaugaagaaccccaccguggacggcaucaccgugaucgaccuggaccccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccaucgaggccggcagaacccugagagugcugagccugguggagaacuggcugaacaacgacacccaguucugcaucaaggugcugaaccccuacaugcccagcgugaucgagaagauggagacccugcagagaaaguacggcggcgcccuggugagaaacccccugagcagaaacagcacccacgagauguacugggugagcaacgccaccggcaacaucgugagcagcgugaacaugaucagcagaaugcugaucaacagauucaccaugaagcacaagaaggccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacguggugcccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcagauucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacauggagggcgagcacaagagacuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcaucuucaagagcauccagcaccugaccgugaccgaggagaucgccgugcagaacuggcuggccagagugggcagagagagacugagcagaauggccaucagcggcgacgacugcguggugaagccccuggacgacagauucgccagcgcccugaccgcccugaacgacaugggcaaggugagaaaggacauccagcagugggagcccagcaagggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugaaggagaccgccugccugggcaagagcuacgcccagauguggagccugauguacuuccacagaagagaccugagacuggccgccaacgccaucugcagcgccgugcccagccacugggugcccaccagcagaaccaccuggagcauccacgccaagcacgaguggaugaccaccgaggacaugcugaccguguggaacagaguguggauccaggagaaccccuggauggaggacaagacccccguggagagcugggaggaggugcccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 17567 - RNA, 9876 nt, Artificial Sequence
  derived and/or modified CDS sequence (opt4) from DENV-2__FM210225__SS-prME
accgccggcgugaucaucaugcugauccccaccgccauggccuuccaccugaccaccagaaacggcgagccccacaugaucgugggcagacaggagaagggcaagagccugcuguucaagaccgaggacggcgugaacaugugcacccugauggccaucgaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgcccagagaaucgagaccuggauccugagacaccccggcuucaccaucauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaacgaggagcaggacaagagauucgugugcaagcacagcaugguggacagaggcuggggcaacggcugcggccuguucggcaagggcggcaucgugaccugcgccauguucaccugcaagaagaacauggagggcaagaucgugcagcccgagaaccuggaguacaccaucgugaucaccccccacagcggcgaggagcacgccgugggcaacgacaccggcaagcacggcaaggagaucaagaucaccccccagagcagcaucaccgaggccgagcugaccggcuacggcaccgugaccauggagugcagccccagaaccggccuggacuucaacgagauggugcugcugcagauggaggacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagaucgugaaggagaucgccgagacccagcacggcaccaucgugaucagagugcaguacgagggcgacggcagccccugcaagauccccuucgagaucauggaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgccaucaucaccuggaucggcaugaacagcagaagcaccagccugagcgugagccuggugcuggugggcgugaucacccuguaccugggcgccauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucaccaccaacaucuggcugaagcugagagagaagcaggacguguucugcgacagcaagcugaugagcgccgccaucaaggacaacagagccgugcacgccgacaugggcuacuggaucgagagcgcccugaacgacaccuggaagauggagaaggccagcuucaucgaggugaagagcugccacuggcccaagagccacacccuguggagcaacggcgugcuggagagcgagaugaucauccccaagagcuucgccggccccgugagccagcacaacuacagacccggcuacuacacccagaccgccggccccuggcaccugggcaagcuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugauggccaccaucggcaucgcccugcugagccagagcaccauccccgagaccauccuggagcugaccgacgcccuggcccugggcaugauggugcugaagaucgugagaaacauggagaaguaccagcuggccgugaccaucauggccaucagcugcgugcccaacgccgugauccugcagaacgccuggaaggugagcugcaccauccuggccgccgugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccaccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggccuguuccccgugagcauccccaucaccgccgccgccugguaccugugggaggugaagaagcagagagccggcgugcugugggacgugcccagccccccccccgugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacagaggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucguggacagaaagggcaagguggugggccuguacggcaacggcguggugaccagaagcggcgccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucaucgacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacagaguggccgccgagggcaucaacuacgccgacagaagauggugcuucgacggcgugaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagagacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcgugggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucgccacccaggagcccgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugaucgcccacuacgccaucaucggccccggccugcaggccaaggccaccagagaggcccagaagagagccgccgccggcaucaugaagaaccccaccguggacggcaucaccgugaucgaccuggaccccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccaucgaggccggcagaacccugagagugcugagccugguggagaacuggcugaacaacgacacccaguucugcaucaaggugcugaaccccuacaugcccagcgugaucgagaagauggagacccugcagagaaaguacggcggcgcccuggugagaaacccccugagcagaaacagcacccacgagauguacugggugagcaacgccaccggcaacaucgugagcagcgugaacaugaucagcagaaugcugaucaacagauucaccaugaagcacaagaaggccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacguggugcccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcagauucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacauggagggcgagcacaagagacuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcaucuucaagagcauccagcaccugaccgugaccgaggagaucgccgugcagaacuggcuggccagagugggcagagagagacugagcagaauggccaucagcggcgacgacugcguggugaagccccuggacgacagauucgccagcgcccugaccgcccugaacgacaugggcaaggugagaaaggacauccagcagugggagcccagcaagggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugaaggagaccgccugccugggcaagagcuacgcccagauguggagccugauguacuuccacagaagagaccugagacuggccgccaacgccaucugcagcgccgugcccagccacugggugcccaccagcagaaccaccuggagcauccacgccaagcacgaguggaugaccaccgaggacaugcugaccguguggaacagaguguggauccaggagaaccccuggauggaggacaagacccccguggagagcugggaggaggugcccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 17568 - RNA, 9876 nt, Artificial Sequence
  derived and/or modified CDS sequence (opt4) from DENV-2__FM210226__SS-prME
accgccggcgugaucaucaugcugauccccaccgccauggccuuccaccugaccaccagaaacggcgagccccacaugaucgugggcagacaggagaagggcaagagccugcuguucaagaccgaggacggcgugaacaugugcacccugauggccaucgaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgcccagagaaucgagaccuggauccugagacaccccggcuucaccaucauggccgccauccuggccuacaccgugggcaccacccacuuccagagagcccugaucuucauccugcuggccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaacgaggagcaggacaagagauucgugugcaagcacagcaugguggacagaggcuggggcaacggcugcggccuguucggcaagggcggcaucgugaccugcgccauguucaccugcaagaagaacauggagggcaagaucgugcagcccgagaaccuggaguacaccaucgugaucaccccccacagcggcgaggagcacgccgugggcaacgacaccggcaagcacggcaaggagaucaagaucaccccccagagccccaucaccgaggccgagcugaccggcuacggcaccgugaccauggagugcagccccagaaccggccuggacuucaacgagauggugcugcugcagauggaggacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagaucgugaaggagaucgccgagacccagcacggcaccaucgugaucagagugcaguacgagggcgacggcagccccugcaagauccccuucgagaucauggaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcgugaucacccuguaccugggcgccauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucaccaccaacaucuggcugaagcugagagagaagcaggacguguucugcgacagcaagcugaugagcgccgccaucaaggacaacagagccgugcacgccgacaugggcuacuggaucgagagcgcccugaacgacaccuggaagauggagaaggccagcuucaucgaggugaagagcugccacuggcccaagagccacacccuguggagcaacggcgugcuggagagcgagaugaucauccccaagagcuucgccggccccgugagccagcacaacuacagacccggcuacuacacccagaccgccggccccuggcaccugggcaagcuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugguggccgugagcuucgugacccugaucaccggcaacaugagcuucagagaccugggcagagugauggugauggugggcgccgccaugaccgacgacaucggcaucggcgugaccuaccuggcccugcuggccgccuucaaggugagacccaccuucgccgccggccugcugcugagaaagcugaccagcaaggagcugaugauggccaccaucggcaucgcccugcugagccagagcaccauccccgagaccauccuggagcugaccgacgcccuggcccugggcaugauggugcugaagaucgugagaaacauggagaaguaccagcuggccgugaccaucauggccaucagcugcgugcccaacgccgugauccugcagaacgccuggaaggugagcugcaccauccuggccaccgugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccaccgacgugaagugggaggaccaggccgagaucagcggcagcagccccauccugagcaucaccaucgccgaggacggcagcaugagcaucaagaacgaggaggaggagcagacccugaccauccugaucagaaccggccugcuggugaucagcggccuguuccccgugagcauccccaucaccgccgccgccugguaccugugggaggugaagaagcagagagccggcgugcugugggacgugcccagccccccccccgugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacagaggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucguggacagaaagggcaagguggugggccuguacggcaacggcguggugaccagaagcggcgccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacagaguggccgccgagggcaucaacuacgccgacagaagauggugcuucgacggcgugaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagagacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcgugggcaagaugacccugggcaugugcugcaucaucaccgccagcauccugcuguggcacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucgccacccaggagcccgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggaccccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccgugcccaugagcaccuacggcuggaaccuggugagacugcagagcggcguggacguguucuucaccccccccgagaagugcgacacccugcugugcgacaucggcgagagcagccccaaccccaccaucgaggccggcagaacccugagagugcugagccugguggagaacuggcugaacaacgacacccaguucugcaucaaggugcugaaccccuacaugcccagcgugaucgagaagauggagacccugcagagaaaguacggcggcgcccuggugagaaacccccugagcagaaacagcacccacgagauguacugggugagcaacgccaccggcaacaucgugagcagcgugaacaugaucagcagaaugcugaucaacagauucaccaugaagcacaagaaggccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacguggugcccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcagauucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacauggagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcaucuucaagagcauccagcaccugaccgugaccgaggagaucgccgugcagaacuggcuggccagagugggcagagagagacugagcagaauggccaucagcggcgacgacugcguggugaagccccuggacgacagauucgccagcgcccugaccgcccugaacgacaugggcaaggugagaaaggacauccagcagugggagcccagcagaggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugaaggagaccgccugccugggcaagagcuacgcccagauguggagccugauguacuuccacagaagagaccugagacuggccgccaacgccaucugcagcgccgugcccagccacugggugcccaccagcagaaccaccuggagcauccacgccaagcacgaguggaugaccaccgaggacaugcugaccguguggaacagaguguggauccaggagaaccccuggauggaggacaagacccccguggagagcugggaggaggugcccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 17569 - RNA, 9876 nt, Artificial Sequence
  derived and/or modified CDS sequence (opt4) from DENV-2__FM210227__SS-prME
accgccggcgugaucaucaugcugauccccaccgccauggccuuccaccugaccaccagaaacggcgagccccacaugaucgugggcagacaggagaagggcaagagccugcuguucaagaccgaggacggcgugaacaugugcacccugauggccaucgaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgcccagagaaucgagaccuggauccugagacaccccggcuucaccaucauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaacgaggagcaggacaagagauucgugugcaagcacagcaugguggacagaggcuggggcaacggcugcggccuguucggcaagggcggcaucgugaccugcgccauguucaccugcaagaagaacauggagggcaagaucgugcagcccgagaaccuggaguacaccaucgugaucaccccccacagcggcgaggagcacgccgugggcaacgacaccggcaagcacggcaaggagaucaagaucaccccccagagcagcgugaccgaggccgagcugaccggcuacggcaccgugaccauggagugcagccccagaaccggccuggacuucaacgagauggugcugcugcagauggaggacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagaucgugaaggagaucgccgagacccagcacggcaccaucgugaucagagugcaguacgagggcgacggcagccccugcaagauccccuucgagaucauggaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgccaucaucaccuggaucggcaugaacagcagaagcaccagccugagcgugagccuggugcuggugggcgugaucacccuguaccugggcgccauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucaccaccaacaucuggcugaagcugagagagaagcaggacguguucugcgacagcaagcugaugagcgccgccaucaaggacaacagagccgugcacgccgacaugggcuacuggaucgagagcacccugaacgacaccuggaagauggagaaggccagcuucaucgaggugaagagcugccacuggcccaagagccacacccuguggagcaacggcgugcuggagagcgagaugaucauccccaagagcuucgccggccccgugagccagcacaacuacagacccggcuaccacacccagaccgccggccccuggcaccugggcaagcuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugauggccaccaucggcaucgcccugcugagccagagcaccauccccgagaccauccuggagcugaccgacgcccuggcccugggcaugaugauccugaagaucgugagaaacauggagaaguaccagcuggccgugaccaucauggccaucagcugcgugcccaacgccgugauccugcagaacgccuggaaggugagcugcaccauccuggccgccgugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccaccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggccuguuccccgugagcauccccaucaccgccgccgccugguaccugugggaggugaagaagcagagagccggcgugcugugggacgugcccagccccccccccgugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacagaggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucguggacagaaagggcaagguggugggccuguacggcaacggcguggugaccagaagcggcgccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacuucggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacagaguggccgccgagggcaucaacuacgccgacagaagauggugcuucgacggcgugaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagagacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcgugggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcguggccacccaggagcccgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggaccccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccaucgaggccggcagaacccugagagugcugagccugguggagaacuggcugaacaacgacacccaguucugcaucaaggugcugaaccccuacaugcccagcgugaucgagaagauggagacccugcagagaaaguacggcggcgcccuggugagaaacccccugagcagaaacagcacccacgagauguacugggugagcaacgccaccggcaacaucgugagcagcgugaacaugaucagcagaaugcugaucaacagauucaccaugaagcacaagaaggccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacguggugcccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcagauucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacaugggcggcgagcacaagagacuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcaucuucaagagcauccagcaccugaccgugaccgaggagaucgccgugcagaacuggcuggccagagugggcagagagagacugagcagaauggccaucagcggcgacgacugcguggugaagccccuggacgacagauucgccagcgcccugaccgcccugaacgacaugggcaaggugagaaaggacauccagcagugggagcccagcaagggcuggaacgacuggacccaggugcccuucugcagccaccacuuccacgaccugaucaugaaggacggcagagugcugguggugcccugcagaaaccaggacgagcugaucggcagagccagaaucagccagggcgccggcuggagccugaaggagaccgccugccugggcaagagcuacgcccagauguggagccugauguacuuccacagaagagaccugagacuggccgccaacgccaucugcagcgccgugcccagccacugggugcccaccagcagaaccaccuggagcauccacgccaagcacgaguggaugaccaccgaggacaugcugaccguguggaacagaguguggauccaggagaaccccuggauggaggacaagacccccguggagagcugggaggaggugcccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 17570 - RNA, 9876 nt, Artificial Sequence
  derived and/or modified CDS sequence (opt4) from DENV-2__FM210204__SS-prME
accgccggcgugaucaucaugcugauccccaccgccauggccuuccaccugaccaccagaaacggcgagccccacaugaucgugggcagacaggagaagggcaagagccugcuguucaagaccgaggacggcgugaacaugugcacccugauggccaucgaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgcccagagaaucgagaccuggauccugagacaccccggcuucaccaucauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaacgaggagcaggacaagagauucgugugcaagcacagcaugguggacagaggcuggggcaacggcugcggccuguucggcaagggcggcaucgugaccugcgccauguucaccugcaagaagaacauggagggcaagaucgugcagcccgagaaccuggaguacaccaucgugaucaccccccacagcggcgaggagcacgccgugggcaacgacaccggcaagcacggcaaggagaucaagaucaccccccagagcagcgugaccgaggccgagcugaccggcuacggcaccgugaccauggagugcagccccagaaccggccuggacuucaacgagauggugcugcugcagauggaggacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagaucgugaaggagaucgccgagacccagcacggcaccaucgugaucagagugcaguacgagggcgacggcagccccugcaagauccccuucgagaucauggaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgccaucaucaccuggaucggcaugaacagcagaagcaccagccugagcgugagccuggugcuggugggcgugaucacccuguaccugggcgccauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggccuacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagccacaaccagaccuuccugaucgacggccuggagaccgccgagugccccaacaccaacagagccuggaacagccuggagguggaggacuacggcuucggcguguucaccaccaacaucuggcugaagcugagagagaagcaggacguguucugcgacagcaagcugaugagcgccgccaucaaggacaacagagccgugcacgccgacaugggcuacuggaucgagagcgcccugaacgacaccuggaagauggagaaggccagcuucaucgaggugaagagcugccacuggcccaagagccacacccuguggagcaacggcgugcuggagagcgagaugaucauccccaagagcuucgccggccccgugagccagcacaacuacagacccggcuaccacacccagaccgccggccccuggcaccugggcaagcuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugguggccgugagcuucgugacccugaucaccggcaacaugagcuucaaggaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugauggccaccaucggcaucgcccugcugagccagagcaccauccccgagaccauccuggagcugaccgacgcccuggcccugggcaugauggugcugaagaucgugagaaacauggagaaguaccagcuggccgugaccaucauggccaucagcugcgugcccaacgccgugauccugcagaacgccuggaaggugagcugcaccauccuggccgccgugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccaccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggccuguuccccgugagcauccccaucaccgccgccgccugguaccugugggaggugaagaagcagagagccggcgugcugugggacgugcccagccccccccccgugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacagaggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucguggacagaaagggcaagguggugggccuguacggcaacggcguggugaccagaagcggcgccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacagaguggccgccgagggcaucaacuacgccgacagaagauggugcuucgacggcgugaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagagacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcgugggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcguggccacccaggagcccgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggaccccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccaucgaggccggcagaacccugagagugcugagccugguggagaacuggcugaacaacgacacccaguucugcaucaaggugcugaaccccuacaugccccccgugaucgagaagauggagacccugcagagaaaguacggcggcgcccuggugagaaacccccugagcagaaacagcacccacgagauguacugggugagcaacgccaccggcaacaucgugagcagcgugaacaugaucagcagaaugcugaucaacagauucaccaugaagcacaagaaggccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacguggugcccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcagauucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacauggagggcgagcacaagagacuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcaucuucaagagcauccagcaccugaccgugaccgaggagaucgccgugcagaacuggcuggccagagugggcagagagagacugagcagaauggccaucagcggcgacgacugcguggugaagccccuggacgacagauucgccagcgcccugaccgcccugaacgacaugggcaaggugagaaaggacauccagcagugggagcccagcaagggcuggaacgacuggacccaggugcccuucugcagccaccacuuccacgaccugaucaugaaggacggcagagugcugguggugcccugcagaaaccaggacgagcugaucggcagagccagaaucagccagggcgccggcuggagccugaaggagaccgccugccugggcaagagcuacgcccagauguggagccugauguacuuccacagaagagaccugagacuggccgccaacgccaucugcagcgccgugcccagccacugggugcccaccagcagaaccaccuggagcauccacgccaagcacgaguggaugaccaccgaggacaugcugaccguguggaacagaguguggauccaggagaaccccuggauggaggacaagacccccguggagagcugggaggaggugcccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 17571 - RNA, 9876 nt, Artificial Sequence
  derived and/or modified CDS sequence (opt4) from DENV-2__FM210230__SS-prME
accgccggcgugaucaucaugcugauccccaccgccauggccuuccaccugaccaccagaaacggcgagccccacaugaucgugggcagacaggagaagggcaagagccugcuguucaagaccgaggacggcgugaacaugugcacccugauggccaucgaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgcccagagaaucgagaccuggauccugagacaccccggcuucaccaucauggccgccauccuggccuacaccgugggcaccacccacuuccagagagcccugaucuucauccugcuggccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaacgaggagcaggacaagagauucgugugcaagcacagcaugguggacagaggcuggggcaacggcugcggccuguucggcaagggcggcaucgugaccugcgccauguucaccugcaagaagaacauggagggcaagaucgugcagcccgagaaccuggaguacaccaucgugaucaccccccacagcggcgaggagcacgccgugggcaacgacaccggcaagcacggcaaggagaucaagaucaccccccagagccccaucaccgaggccgagcugaccggcuacggcaccgugaccauggagugcagccccagaaccggccuggacuucaacgagauggugcugcugcagauggaggacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagaucgugaaggagaucgccgagacccagcacggcaccaucgugaucagagugcaguacgagggcgacggcagccccugcaagauccccuucgagaucauggaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcgugaucacccuguaccugggcgccauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucaccaccaacaucuggcugaagcugagagagaagcaggacguguucugcgacagcaagcugaugagcgccgccaucaaggacaacagagccgugcacgccgacaugggcuacuggaucgagagcgcccugaacgacaccuggaagauggagaaggccagcuucaucgaggugaagagcugccacuggcccaagagccacacccuguggagcaacggcgugcuggagagcgagaugaucauccccaagagcuucgccggccccgugagccagcacaacuacagacccggcuacuacacccagaccgccggccccuggcaccugggcaagcuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcuggugaccgugagcuucgugacccugaucaccggcaacaugagcuucagagaccugggcagagugauggugauggugggcgccgccaugaccgacgacaucggcaugggcgugaccuaccuggcccugcuggccgccuucaaggugagacccaccuucgccgccggccugcugcugagaaagcugaccagcaaggagcugaugauggccaccaucggcaucgcccugcugagccagagcaccauccccgagaccauccuggagcugaccgacgcccuggcccugggcaugauggugcugaagaucgugagaaacauggagaaguaccagcuggccgugaccaucauggccaucagcugcgugcccaacgccgugauccugcagaacgccuggaaggugagcugcaccauccuggccgccgugagcgugagccccaugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccaccgacgugaagugggaggaccaggccgagaucagcggcagcagccccauccugagcaucaccaucgccgaggacggcagcaugagcaucaagaacgaggaggaggagcagacccugaccauccugaucagaaccggccugcuggugaucagcggccuguuccccgugagcauccccaucaccgccgccgccugguaccugugggaggugaagaagcagagagccggcgugcugugggacgugcccagccccccccccgugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacagaggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucguggacagaaagggcaagguggugggccuguacggcaacggcguggugaccagaagcggcgccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacagaguggccgccgagggcaucaacuacgccgacagaagauggugcuucgacggcgugaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagagacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcgugggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucgccacccaggagcccgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcgugaccgugaucgaccuggaccccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaaggacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccaucgaggccggcagaacccugagagugcugagccugguggagaacuggcugaacaacgacacccaguucugcaucaaggugcugaaccccuacaugcccagcgugaucgagaagauggagacccugcagagaaaguacggcggcgcccuggugagaaacccccugagcagaaacagcacccacgagauguacugggugagcaacgccaccggcaacaucgugagcagcgugaacaugaucagcagaaugcugaucaacagauucaccaugaagcacaagaaggccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacguggugcccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaucugcaccagagaggaguucaccagaaaggugagaagcaacgccgcccugggcgccaucuucaccgacgagaacaaguggaagagcgccagagaggccguggaggacagcagauucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagacgugagcaagaagggcggcggcgccauguacgccgacgacaccgccggcugggacaccagaaucacccuggaggaccugaagaacgaggagauggugaccaaccacauggagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcguguucaagagcauccagagacugaccgugaccgaggagaucgccgugcagaacuggcuggccagagugggcagagagagacugagcagaauggccaucagcggcgacgacugcguggugaagccccuggacgacagauucgccagcgcccugaccgcccugaacgacaugggcaaggugagaaaggacauccagcagugggagcccagcagaggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugaaggagaccgccugccugggcaagagcuacgcccagauguggagccugauguacuuccacagaagagaccugagacuggccgccaacgccaucugcagcgccgugcccagccacugggugcccaccagcagaaccaccuggagcauccacgccaagcacgaguggaugaccaccgaggacaugcugaccguguggaacagaguguggauccaggagaaccccuggauggaggacaagacccccguggagagcugggaggaggugcccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 17572 - RNA, 9876 nt, Artificial Sequence
  derived and/or modified CDS sequence (opt4) from DENV-2__KC762665__SS-prME
accgccggcaucaucaucaugaugauccccaccgugauggccuuccaccugaccaccagaaacggcgagccccacaugaucgugagcagacaggagaagggcaagagccugcuguucaagaccgagaacggcgugaacaugugcacccugauggccauggaccugggcgagcugugcgaggacaccaucaccuacaacugcccccugcugagacagaacgagcccgaggacaucgacugcuggugcaacagcaccagcaccugggugaccuacggcaccugcaccgccaccggcgagcacagaagagagaagagaagcguggcccuggugccccacgugggcaugggccuggagaccagaaccgagaccuggaugagcagcgagggcgccuggaagcacgcccagagaaucgagaccugggugcugagacaccccggcuucaccaucauggccgccauccuggccuacaccaucggcaccaccuacuuccagagagugcugaucuucauccugcugaccgccgugacccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcaccccgccacccugagaaaguacugcaucgaggccaagcugaccaacaccaccaccgccagcagaugccccacccagggcgagcccagccugaacgaggagcaggacaagagauucgugugcaagcacagcaugguggacagaggcuggggcaacggcugcggccuguucggcaagggcggcaucgugaccugcgccauguucaccugcaagaagaacauggagggcaagaucgugcagcccgagaaccuggaguacaccaucgugaucaccccccacagcggcgaggagaacgccgugggcaacgacaccggcaagcacggcaaggagaucaaggugaccccccagagcagcaucaccgaggccgagcugaccggcuacggcaccgugaccauggagugcagccccagaaccggccuggacuucaacgagauggugcugcugcagauggagaacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucgugaucagagugcaguacgagggcgacggcagccccugcaagauccccuucgagaucauggaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugagcugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcguggugaucaccuggaucggcaugaacagcagaagcaccagccugagcgugagccuggugcuggugggcguggugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagcugcacaaccacaccuuccugaucgacggccccgagaccgccgagugccccaacgccaacagagccuggaacagccuggagguggaggacuacggcuucggcguguucaccaccaacaucuggcugaagcugaaggagagacaggacgccuucugcgacagcaagcugaugagcgccgccaucaaggacaacagagccgugcacgccgacaugggcuacuggaucgagagcgcccugaacgacaccuggaagaucgagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcagacuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugaugaccaccaucggcaucacccugcugagccagagcaccauccccgagaccauccuggagcugaccgacgcccuggcccugggcaugauggugcugaagaucgugagaaacauggagaaguaccagcuggccgugaccaucauggccauccugugcgugcccaacgccgugauccugcagaacgccuggaaggugagcugcaccacccuggccguggugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugagaugggaggagcaggccgagaucagcggcagcagccccauccugagcaucaccaucagcgaggacggcagcaugagcaucaagaacgaggaggaggagcagacccugaccauccugaucagaaccggccugcuggugaucagcggccuguuccccgugagcauccccaucaccgccgccgccugguaccugugggaggugaagaagcagagagccggcgugcugugggacgugcccagccccccccccgugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacaagggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccagcaccggcaccaucggcgccgugagccuggacuucagccccggcaccagcggcagccccaucguggacaagaagggcaagguggugggccuguacggcaacggcguggugaccagaagcggcaccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccaucagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacuucgaguacaucaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagagugggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacagaguggccgccgagggcaucaacuacgccgacagaagauggugcuucgacggcgugaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagaaacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggacuucggccugggcagcaucaccacccagcagcccgagagcaacauccuggacaucgaccugagacccgccagcgccuggacccuguacgccguggccaccaccuucaucacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggaccccauccccuacgaccccaaguucgagaagcagcugggccaggugaugcugcuggugcugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccgccaacaccagaagaggcaccggcaacaccggcgagacccugggcgagaaguggaagaacagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaaccugguggcccccgagggcaaggugguggaccugggcugcggcagaggcggcuggagcuacuacugcggcggccugaagaacgugaaggaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccguggaggccggcagaacccugagagugcugaaccugguggagaacuggcugaacaacaacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccagcggcaacaucgugagcagcgugaacaugaucagcagaaugcugaucaacagauucaccaugagacacaagaaggccaccuacgagcccgacguggaccugggcagcggcaccagaaacaucggcaucgagagcgagacccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacgugauccccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcggcuucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacauggagggcgagcacaagaagcuggccgaggccaucuucaagcugaccuaccagaacaagguggugagagugcagagacccacccccagaggcaccgugauggacaucaucagcagaagagaccagagaggcagcggccagguggugaccuacggccugaacaccuucaccaacauggaggcccagcugaucagacagauggagggcgagggcguguucaagagcauccagcagcugaccgugaccgaggagaucgccgugaagaacuggcuggugagagugggcagagagagacugagcagaauggccaucagcggcgacgacugcguggugaagccccuggacgacagauucgccagcgcccugaccgcccugaacgacaugggcaaggugagaaaggacauccagcagugggagcccagcagaggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugagagagaccgccugccugggcaagagcuacgcccagauguggagccugauguacuuccacagaagagaccugagacuggccgccaacgccaucugcagcgccgugcccagccacugggugcccaccagcagaaccaccuggagcauccacgccacccacgaguggaugaccaccgaggacaugcugaccguguggaacagaguguggauccaggagaaccccuggauggaggacaagacccccguggagagcugggaggagauccccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 17573 - RNA, 9876 nt, Artificial Sequence
  derived and/or modified CDS sequence (opt4) from DENV-2__KC762669__SS-prME
accgccggcaucaucaucauggugauccccaccgugauggccuuccaccugaccaccagaaacggcgagccccacaugaucgugagcagacaggagaagggcaagagccugcuguucaagaccgagaacggcgugaacaugugcacccugauggccauggaccugggcgagcugugcgaggacaccaucaccuacaacugcccccugcugagacagaacgagcccgaggacaucgacugcuggugcaacagcaccagcaccugggugaccuacggcaccugcaccgccaccggcgagcacagaagagagaagagaagcguggcccuggugccccacgugggcaugggccuggagaccagaaccgagaccuggaugagcagcgagggcgccuggaagcacgcccagagaaucgagaccugggugcugagacaccccggcuucaccaucauggccgccauccuggccuacaccaucggcaccaccuacuuccagagagugcugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcaccccgccacccugagaaaguacugcaucgaggccaagcugaccaacaccaccaccgccagcagaugccccacccagggcgagcccagccugaacgaggagcaggacaagagauucgugugcaagcacagcaugguggacagaggcuggggcaacggcugcggccuguucggcaagggcggcaucgugaccugcgccauguucaccugcaagaagaacauggagggcaagaucgugcagcccgagaaccuggaguacaccaucgugaucaccccccacagcggcgaggagaacgccgugggcaacgacaccggcaagcacggcaaggagaucaaggugaccccccagagcagcaucaccgaggccgagcugaccggcuacggcaccgugaccauggagugcagccccagaaccggccuggacuucaacgagauggugcugcugcagauggagaacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucgugaucagagugcaguacgagggcgacggcagccccugcaagauccccuucgagaucauggaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugagcugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcguggugaucaccuggaucggcaugaacagcagaagcaccagccugagcgugagccuggugcuggugggcguggugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaaggccuggggcaaggccaagaugcugagcaccgagcugcacaaccacaccuuccugaucgacggccccgagaccgccgagugccccaacaccaacagagccuggaacagccuggagguggaggacuacggcuucggcguguucaccaccaacaucuggcugaagcugaaggagagacaggacguguucugcgacagcaagcugaugagcgccgccaucaaggacaacagagccgugcacgccgacaugggcuacuggaucgagagcgcccugaacgacaccuggaagaucgagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcagacuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugaugaccaccaucggcaucgugcugcugagccagagcaccauccccgagaccauccuggagcugaccgacgcccuggcccugggcaugauggugcugaagaucgugagaaacauggagaaguaccagcuggccgugaccaucauggccauccugugcgugcccaacgccgugauccugcagaacgccuggaaggugagcugcaccacccuggccguggugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugagaugggaggagcaggccgagaucagcggcagcagccccauccugagcaucaccaucagcgaggacggcagcaugagcaucaagaacgaggaggaggagcagacccugaccauccugaucagaaccggccugcuggugaucagcggccuguuccccgugagcauccccaucaccgccgccgccugguaccugugggaggugaagaagcagagagccggcgugcugugggacgugcccagccccccccccgugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacaagggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaucaucggcgccgugagccuggacuucagccccggcaccagcggcagccccaucguggacaagaagggcaagguggugggccuguacggcaacggcguggugaccagaagcggcaccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccaucagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacuucgaguacaucaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagagugggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacagaguggccgccgagggcaucaacuacgccgacagaagauggugcuucgacggcgugaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagaaacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggacuucggccugggcagcaucaccacccagcagcuggagagcaacauccuggacaucgaccugagacccgccagcgccuggacccuguacgccguggccaccaccuucaucacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggaccccauccccuacgaccccaaguucgagaagcagcugggccaggugaugcugcuggugcugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccgccaacaccagaagaggcaccggcaacaccggcgagacccugggcgagaaguggaagaacagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaaccuggugacccccgagggcaaggugguggaccugggcugcggcagaggcggcuggagcuacuacugcggcggccugaagaacgugaaggaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccguggaggccggcagaacccugagagugcugaaccugguggagaacuggcugaacaacaacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccagcggcaacaucgugagcagcgugaacaugaucagcagaaugcugaucaacagauucaccaugagacacaagaaggccaccuacgagcccgacguggaccugggcagcggcaccagaaacaucggcaucgagagcgagacccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacgugauccccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcggcuucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacauggagggcgagcacaagagacuggccgaggccaucuucagacugaccuaccagaacaagguggugagagugcagagacccacccccagaggcaccgugauggacaucaucagcagaagagaccagagaggcagcggccagguggugaccuacggccugaacaccuucaccaacauggaggcccagcugaucagacagauggagggcgagggcguguucaagagcauccagcaccugaccgugaccgaggagaucgccgugaagaacuggcuggccagagugggcagagagagacugagcagaauggccaucagcggcgacgacugcguggugaagccccuggacgacagauucgccagcgcccugaccgcccugaacgacaugggcaaggugagaaaggacauccagcagugggagcccagcagaggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugagagagaccgccugccugggcaagagcuacgcccagauguggagccugauguacuuccacagaagagaccugagacuggccgccaacgccaucugcagcgccgugcccagccacugggugcccaccagcagaaccaccuggagcauccacgccacccacgaguggaugaccaccgaggacaugcugaccguguggaacagaguguggauccaggagaaccccuggauggaggacaagacccccguggagagcugggaggagauccccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 17574 - RNA, 9876 nt, Artificial Sequence
  derived and/or modified CDS sequence (opt4) from DENV-2__KC762658__SS-prME
accgccggcaucaucaucaugaugauccccaccgugauggccuuccaccugaccaccagaaacggcgagccccacaugaucgugagcagacaggagaagggcaagagccugcuguucaagaccgagaacggcgugaacaugugcacccugauggccauggaccugggcgagcugugcgaggacaccaucaccuacaacugcccccugcugagacagaacgagcccgaggacaucgacugcuggugcaacagcaccagcaccugggugaccuacggcaccugcaccgcccccggcgagcacagaagagagaagagaagcguggcccuggugccccacgugggcaugggccuggagaccagaaccgagaccuggaugagcagcgagggcgccggcaagcacgcccagagaaucgagaccugggugcugagacaccccggcuucaccaucauggccgccauccuggccuacaccaucggcaccaccuacuuccagagagugcugaucuucauccugcugaccgccgugacccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcugcccgccacccugagaaaguacugcaucgaggccaagcugaccaacaccaccaccgccagcagaugccccacccagggcgagcccagccugaacgaggagcaggacaagagauucgugugcaagcacagcaugguggacagaggcuggggcaacggcugcggccuguucggcaagggcggcaucgugaccugcgccauguucaccugcaagaagaacauggagggcaagaucgugcagcccgagaaccuggaguacaccaucgugaucaccccccacagcggcgaggagaacgccgugggcaacgacaccggcaagcacggcaaggagaucaaggugaccccccagagcagcaucaccgaggccgagcugaccggcuacggcaccgugaccauggagugcagccccagaaccggccuggacuucaacgagauggugcugcugcagauggagaacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucgugaucagagugcaguacgagggcgacggcagccccugcaagauccccuucgagaucauggaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugagcugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcguggugaucaccuggaucggcaugaacagcagaagcaccagccugagcgugagccuggugcuggugggcguggugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagcugcacaaccacaccuuccugaucgacggccccgagaccgccgagugccccaacaccaacagagccuggaacagccuggagguggaggacuacggcuucggcguguucaccaccaacaucuggcugaagcugaaggagagacaggacguguucugcgacagcaagcugaugagcgccgccaucaaggacaacagagccgugcacgccgacaugggcuacuggaucgagagcgcccugaacgacaccuggaagaucgagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcagacuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugaugaccaccaucggcaucgugcugcugagccagagcaccauccccgagaccauccuggagcugaccgacgcccuggcccugggcaugauggugcugaagaucgugagaaacauggagaaguaccagcuggccgugaccaucauggccauccugugcgugcccaacgccgugauccugcagaacgccuggaaggugagcugcaccacccuggccguggugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugagaugggaggagcaggccgagaucagcggcagcagccccauccugagcaucaccaucagcgaggacggcagcaugagcaucaagaacgaggaggaggagcagacccugaccauccugaucagaaccggccugcuggugaucagcggccuguuccccgugagcauccccaucaccgccgccgccugguaccugugggaggugaagaagcagagagccggcgugcugugggacgugcccagccccccccccgugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacaagggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucguggacaagaagggcaagguggugggccuguacggcaacggcguggugaccagaagcggcaccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccaucagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacuucgaguacaucaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagagugggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggagcugaugagaagaggcgaccugcccguguggcuggccuacagaguggccgccgagggcaucaacuacgccgacagaagauggugcuucgacggcgugaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagaaacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggacuucggccugggcagcaucaccacccagcagcccgagagcaacauccuggacaucgaccugagacccgccagcgccuggacccuguacgccguggccaccaccuucaucacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggaccccauccccuacgaccccaaguucgagaagcagcugggccaggugaugcugcuggugcugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccgccaacaccagaagaggcaccggcaacaccggcgagacccugggcgagaaguggaagaacagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaaccuggugacccccgagggcaaggugguggaccugggcugcggcagaggcggcuggagcuacuacugcggcggccugaagaacgugaaggaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccguggaggccggcagaacccugagagugcugaaccugguggagaacuggcugaacaacaacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccagcggcaacaucgugagcagcgugaacaugaucagcagaaugcugaucaacagauucaccaugagacacaagaaggccaccuacgagcccgacguggaccugggcagcggcaccagaaacaucggcaucgagagcgagacccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacgugauccccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcggcuucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacauggagggcgagcacaagaagcuggccgaggccaucuucaagcugaccuaccagaacaagguggugagagugcagagacccacccccagaggcaccgugauggacaucaucagcagaagagaccagagaggcagcggccagguggugaccuacggccugaacaccuucaccaacauggaggcccagcugaucagacagauggagggcgagggcguguucaagagcauccagcagcugaccgugaccgaggagaucgccgugaagaacuggcuggugagagugggcagagagagacugagcagaauggccaucagcggcgacgacugcguggugaagccccuggacgacagauucgccagcgcccugaccgcccugaacgacaugggcaaggugagaaaggacauccagcagugggagcccagcagaggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugagagagaccgccugccugggcaagagcuacgcccagauguggagccugauguacuuccacagaagagaccugagacuggccgccaacgccaucugcagcgccgugcccagccacugggugcccaccagcagaaccaccuggagcauccacgccacccacgaguggaugaccaccgaggacaugcugaccguguggaacagaguguggauccaggagaaccccuggauggaggacaagacccccguggagagcugggaggagauccccuaccugggcaagagagaggaccaguggugcggcagccugaucggccugaccagcagagccaccugggccaagaacauccagaccgccaucaaccaggugagaagccugaucggcaacgagaaguacaccgacuacaugcccagcaugaagagauucagaagagaggaggaggaggccggcgugcugugguga

SEQ ID NO: 17575 - RNA, 9876 nt, Artificial Sequence
  derived and/or modified CDS sequence (opt4) from DENV-2__KC762660__SS-prME
accgccggcaucaucaucaugaugauccccaccgugauggccuuccaccugaccaccagaaacggcgagccccacaugaucgugagcagacaggagaagggcaagagccugcuguucaagaccgagaacggcgugaacaugugcacccugauggccauggaccugggcgagcugugcgaggacaccaucaccuacaacugcccccugcugagacagaacgagcccgaggacaucgacugcuggugcaacagcaccagcaccugggugaccuacggcaccugcaccgccaccggcgagcacagaagagagaagagaagcguggcccuggugccccacgugggcaugggccuggagaccagaaccgagaccuggaugagcagcgagggcgccuggaagcacgcccagagaaucgagaccugggugcugagacaccccggcuucaccaucauggccgccauccuggccuacaccaucggcaccaccuacuuccagagagugcugaucuucauccugcugaccgccgugacccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcaccccgccacccugagaaaguacugcaucgaggccaagcugaccaacaccaccaccgccagcagaugccccacccagggcgagcccagccugaacgaggagcaggacaagagauucgugugcaagcacagcaugguggacagaggcuggggcaacggcugcggccuguucggcaagggcggcaucgugaccugcgccauguucaccugcaagaagaacauggagggcaagguggugcagcccgagaaccuggaguacaccaucgugaucaccccccacagcggcgaggagaacgccgugggcaacgacaccggcaagcacggcaaggagaucaaggugaccccccagagcagcaucaccgaggccgagcugaccggcuacggcaccgugaccauggagugcagccccagaaccggccuggacuucaacgagauggugcugcugcagauggagaacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucgugaucagagugcaguacgagggcgacggcagccccugcaagauccccuucgagaucauggaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugagcugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcguggugaucaccuggaucggcaugaacagcagaagcaccagccugagcgugagccuggugcuggugggcguggugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagcugcacaaccacaccuuccugaucgacggccccgagaccgccgagugccccaacaccaacagagccuggaacagccuggagguggaggacuacggcuucggcguguucaccaccaacaucuggcugaagcugaaggagagacaggacguguucugcgacagcaagcugaugagcgccgccaucaaggacaacagagccgugcacgccgacaugggcuacuggaucgagagcgcccugaacgacaccuggaagaucgagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcagacuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugaugaccaccaucggcaucgugcugcugagccagagcaccauccccgagagcauccuggagcugaccgacgcccuggcccugggcaugauggugcugaagaucgugagaaacauggagaaguaccagcuggccgugaccaucauggccauccugugcgugcccaacgccgugauccugcagaacgccuggaaggugagcugcaccacccuggccguggugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugagaugggaggagcaggccgagaucagcggcagcagccccauccugagcaucaccaucagcgaggacggcagcaugagcaucaagaacgaggaggaggagcagacccugaccauccugaucagaaccggccugcuggugaucagcggccuguuccccgugagcauccccaucaccgccgccgccugguaccugugggaggugaagaagcagagagccggcgugcugugggacgugcccagccccccccccgugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacaagggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucguggacaagaagggcaagguggugggccuguacggcaacggcguggugaccagaagcggcaccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccaucagagugcccaacuacaaccugaucaucauggacgaggcccacuucaucgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacuucgaguacaucaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagagugggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacagaguggccgccgagggcaucaacuacgccgacagaagauggugcuucgacggcgugaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccaagaacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggacuucggccugggcagcaucaccacccagcagcccgagagcaacauccuggacaucgaccugagacccgccagcgccuggacccuguacgccguggccaccaccuucaucacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggaccccauccccuacgaccccaaguucgagaagcagcugggccaggugaugcugcuggugcugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccgccaacaccagaagaggcaccggcaacaccggcgagacccugggcgagaaguggaagaacagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaaccuggugacccccgagggcaaggugguggaccugggcugcggcagaggcggcuggagcuacuacugcggcggccugaagaacgugaaggaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccguggaggccggcagaacccugagagugcugaaccugguggagaacuggcugaacaacaacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccagcggcaacaucgugagcagcgugaacaugaucagcagaaugcugaucaacagauucaccaugagacacaagaaggccaccuacgagcccgacguggaccugggcagcggcaccagaaacaucggcaucgagagcgagacccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacgugauccccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcggcuucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacauggagggcgagcacaagaagcuggccgaggccaucuucaagcugaccuaccagaacaagguggugagagugcagagacccacccccagaggcaccgugauggacaucaucagcagaagagaccagagaggcagcggccagguggugaccuacggccugaacaccuucaccaacauggaggcccagcugaucagacagauggagggcgagggcguguucaagagcauccagcagcugaccgugaccgaggagaucgccgugaagaacuggcuggugagagugggcagagagagacugagcagaauggccaucagcggcgacgacugcguggugaagccccuggacgacagauucgccagcgcccugaccgcccugaacgacaugggcaaggugagaaaggacauccagcagugggagcccagcagaggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugcaggagaccgccugccugggcaagagcuacgcccagauguggagccugauguacuuccacagaagagaccugagacuggccgccaacgccaucugcagcgccgugcccagccacugggugcccaccagcagaaccaccuggagcauccacgccacccacgaguggaugaccaccgaggacaugcugaccguguggaacagaguguggauccaggagaaccccuggauggaggacaagacccccguggagagcugggaggagauccccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 17576 - RNA, 9876 nt, Artificial Sequence
  derived and/or modified CDS sequence (opt4) from DENV-2__KC762676__SS-prME
accgccggcaucaucaucaugaugauccccaccgugauggccuuccaccugaccaccagaaacggcgagccccacaugaucgugagcagacaggagaagggcaagagccugcuguucaagaccgagaacggcgugaacaugugcacccugauggccauggaccugggcgagcugugcgaggacaccaucaccuacaacugcccccugcugagacagaacgagcccgaggacaucgacugcuggugcaacagcaccagcaccugggugaccuacggcaccugcaccgccaccggcgagcacagaagagagaagagaagcguggcccuggugccccacgugggcaugggccuggagaccagaaccgagaccuggaugagcagcgagggcgccuggaagcacgcccagagaaucgagaccugggugcugagacaccccggcuucaccaucauggccgccauccuggccuacaccaucggcaccacccacuuccagagagugcugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcaccccgccacccugagaaaguacugcaucgaggccaagcugaccaacaccaccaccgccagcagaugccccacccagggcgagcccagccugaacgaggagcaggacaagagauucgugugcaagcacagcaugguggacagaggcuggggcaacggcugcggccuguucggcaagggcggcaucgugaccugcgccauguucaccugcaagaagaacauggagggcaagaucgugcagcccgagaaccuggaguacaccaucgugaucaccccccacagcggcgaggagaacgccgugggcaacgacaccggcaagcacggcaaggagaucaaggugaccccccagagcagcaucaccgaggccgagcugaccggcuacggcaccgugaccauggagugcagccccagaaccggccuggacuucaacgagauggugcugcugcagauggagaacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucgugaucagagugcaguacgagggcgacggcagccccugcaagauccccuucgagaucauggaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugagcugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcguggugaucaccuggaucggcaugaacagcagaagcaccagccugagcgugagccuggugcuggugggcguggugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagcugcacaaccacaccuuccugaucgacggccccgagaccgccgagugccccaacaccaacagagccuggaacagccuggagguggaggacuacggcuucggcguguucaccaccaacaucuggcugaagcugaaggagagacaggacguguacugcgacagcaagcugaugagcgccgccaucaaggacaacagagccgugcacgccgacaugggcuacuggaucgagagcgcccugaacgacaccuggaagaucgagaaggccagcuucaucgaggugaagagcugcuacuggcccaagagccacacccuguggagcaacggcgugcuggagagcgagaugaucauccccaagaacuucgccggccccgugagccagcacaacuacagacccggcuaccacacccagaccgccggccccuggcaccugggcagacuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugaugaccaccaucggcaucgugcugcugagccagagcaccauccccgagaccauccuggagcugaccgacgcccuggcccugggcaugauggcccugaagaucgugagaaacauggagaaguaccagcuggccgugaccaucauggccauccugugcgugcccaacgccgugauccugcagaacgccuggaaggugagcugcaccacccuggccguggugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugagaugggaggagcaggccgagaucagcggcagcagccccauccugagcaucaccaucagcgaggacggcagcaugagcaucaagaacgaggaggaggagcagacccugaccauccugaucagaaccggccugcuggugaucagcggccuguuccccgugagcauccccaucaccgccgccgccugguaccugugggaggugaagaagcagagagccggcgugcugugggacgugcccagccccccccccgugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacaagggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucguggacaagaagggcaagguggugggccuguacggcaacggcguggugaccagaagcggcaccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccaucagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacuucgaguacaucaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagagugggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacagaguggccgccgagggcaucaacuacgccgacagaagauggugcuucgacggcgugaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagaaacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggacuucggccugggcagcaucaccacccagcagcccgagagcaacauccuggacaucgaccugagacccgccagcgccuggacccuguacgccguggccaccaccuucaucacccccaugcugagacacagcaucgagaacagcagcgugaacgugagccugaccgccaucgccaaccaggccaccgugcugaugggccugggcaagggcuggccccugagcaagauggacaucggcgugagccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggaccccauccccuacgaccccaaguucgagaagcagcugggccaggugaugcugcuggugcugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccgccaacaccagaagaggcaccggcaacaccggcgagacccugggcgagaaguggaagaacagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaaccuggugacccccgagggcaaggugguggaccugggcugcggcagaggcggcuggagcuacuacugcggcggccugaagaacgugaaggaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccguggaggccggcagaacccugagagugcugaaccugguggagaacuggcugaacaacaacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccagcggcaacaucgugagcagcgugaacaugaucagcagaaugcugaucaacagauucaccaugagacacaagaaggccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacagaaccugggccuaccacggcagcuacgagaccaagcagaccggcagcgccagcagcauggugaacggcguggugagacugcugaccaagcccugggacgugauccccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcggcuucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacauggagggcgagcacaagaagcuggccgaggccaucuucaagcugaccuaccagaacaagguggugagagugcagagacccacccccagaggcaccgugauggacaucaucagcagaagagaccagagaggcagcggccagguggugaccuacggccugaacaccuucaccaacauggaggcccagcugaucagacagauggagggcgagggcguguucaagagcauccagcagcugaccgugaccgaggagaucgccgugaagaacuggcuggugagagugggcagagagagacugagcagaauggccaucagcggcgacgacugcguggugaagccccuggacgacagauucgccaacgcccugaccgcccugaacgacaugggcaaggugagaaaggacauccagcagugggagcccagcagaggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugagagagaccgccugccugggcaagagcuacgcccagauguggagccugauguacuuccacagaagagaccugagacuggccgccaacgccaucugcagcgccgugcccagccacugggugcccaccagcagaaccaccuggagcauccacgccacccacgaguggaugaccaccgaggacaugcugaccguguggaacagaguguggauccaggagaaccccuggauggaggacaagacccccguggagagcugggaggagauccccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 17577 - RNA, 9876 nt, Artificial Sequence
  derived and/or modified CDS sequence (opt4) from DENV-2__KC762662__SS-prME
accgccggcaucaucaucaugaugauccccaccgugauggccuuccaccugaccaccagaaacggcgagccccacaugaucgugagcagacaggagaagggcaagagccugcuguucaagaccgagaacggcgugaacaugugcacccugauggccauggaccugggcgagcugugcgaggacaccaucaccuacaacugcccccugcugagacagaacgagcccgaggacaucgacugcuggugcaacagcaccagcaccugggugaccuacggcaccugcaccgccaccggcgagcacagaagagagaagagaagcguggcccuggugccccacgugggcaugggccuggagaccagaaccgagaccuggaugagcagcgagggcgccuggaagcacgcccagagaaucgagaccugggugcugagacaccccggcuucaccaucauggccgccauccuggccuacaccaucggcaccaccuacuuccagagagugcugaucuucauccugcugaccgccgugacccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcaccccgccacccugagaaaguacugcaucgaggccaagcugaccaacaccaccaccgccagcagaugccccacccagggcgagcccagccugaacgaggagcaggacaagagauucgugugcaagcacagcaugguggacagaggcuggggcaacggcugcggccuguucggcaagggcggcaucgugaccugcgccauguucaccugcaagaagaacauggagggcaagaucgugcagcccgagaaccuggaguacaccaucgugaucaccccccacagcggcgaggagaacgccgugggcaacgacaccggcaagcacggcaaggagaucaaggugaccccccagagcagcaucaccgaggccgagcugaccggcuacggcaccgugaccauggagugcagccccagaaccggccuggacuucaacgagauggugcugcugcagauggagaacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucgugaucagagugcaguacgagggcgacggcagccccugcaagauccccuucgagaucauggaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugagcugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcguggugaucaccuggaucggcaugaacagcagaagcaccagccugagcgugagccuggugcuggugggcguggugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagcugcacaaccacaccuuccugaucgacggccccgagaccgccgagugccccaacgccaacagagccuggaacagccuggagguggaggacuacggcuucggcguguucaccaccaacaucuggcugaagcugaaggagagacaggacgccuucugcgacagcaagcugaugagcgccgccaucaaggacaacagagccgugcacgccgacaugggcuacuggaucgagagcgcccugaacgacaccuggaagaucgagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcagacuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugaugaccaccaucggcaucacccugcugagccagagcaccauccccgagaccauccuggagcugaccgacgcccuggcccugggcaugauggugcugaagaucgugagaaacauggagaaguaccagcuggccgugaccaucauggccauccugugcgugcccaacgccgugauccugcagaacgccuggaaggugagcugcaccacccuggccguggugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugagaugggaggagcaggccgagaucagcggcagcagccccauccugagcaucaccaucagcgaggacggcagcaugagcaucaagaacgaggaggaggagcagacccugaccauccugaucagaaccggccugcuggugaucagcggccuguuccccgugagcauccccaucaccgccgccgccugguaccugugggaggugaagaagcagagagccggcgugcugugggacgugcccagccccccccccgugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacaagggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccagcaccggcaccaucggcgccgugagccuggacuucagccccggcaccagcggcagccccaucguggacaagaagggcaagguggugggccuguacggcaacggcguggugaccagaagcggcaccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccaucagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacuucgaguacaucaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagagugggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacagaguggccgccgagggcaucaacuacgccgacagaagauggugcuucgacggcgugaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagaaacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcgugggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggacuucggccugggcagcaucaccacccagcagcccgagagcaacauccuggacaucgaccugagacccgccagcgccuggacccuguacgccguggccaccaccuucaucacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggaccccauccccuacgaccccaaguucgagaagcagcugggccaggugaugcugcuggugcugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccgccaacaccagaagaggcaccggcaacaccggcgagacccugggcgagaaguggaagaacagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaaccuggugacccccgagggcaaggugguggaccugggcugcggcagaggcggcuggagcuacuacugcggcggccugaagaacgugaaggaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccguggaggccggcagaacccugagagugcugaaccugguggagaacuggcugaacaacaacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccagcggcaacaucgugagcagcgugaacaugaucagcagaaugcugaucaacagauucaccaugagacacaagaaggccaccuacgagcccgacguggaccugggcagcggcaccagaaacaucggcaucgagagcgagacccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacgugauccccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcggcuucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacauggagggcgagcacaagaagcuggccgaggccaucuucaagcugaccuaccagaacaagguggugagagugcagagacccacccccagaggcaccgugauggacaucaucagcagaagagaccagagaggcagcggccagguggugaccuacggccugaacaccuucaccaacauggaggcccagcugaucagacagauggagggcgagggcguguucaagagcauccagcagcugaccgugaccgaggagaucgccgugaagaacuggcuggugaccgugggcagagagagacugagcagaauggccaucagcggcgacgacugcguggugaagccccuggacgacagauucgccagcgcccugaccgcccugaacgacaugggcaaggugagaaaggacauccagcagugggagcccagcagaggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugagagagaccgccugccugggcaagagcuacgcccagauguggagccugauguacuuccacagaagagaccugagacuggccgccaacgccaucugcagcgccgugcccagccacugggugcccaccagcagaaccaccuggagcauccacgccacccacgaguggaugaccaccgaggacaugcugaccguguggaacagaguguggauccaggagaaccccuggauggaggacaagacccccguggagagcugggaggagauccccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 17578 - RNA, 9876 nt, Artificial Sequence
  derived and/or modified CDS sequence (opt4) from DENV-2__KC762661__SS-prME
accgccggcaucaucaucaugaugauccccaccgugauggccuuccaccugaccaccagaaacggcgagccccacaugaucgugagcagacaggagaagggcaagagccugcuguucaagaccgagaacggcgugaacaugugcacccugauggccauggaccugggcgagcugugcgaggacaccaucaccuacaacugcccccugcugagacagaacgagcccgaggacaucgacugcuggugcaacagcaccagcaccugggugaccuacggcaccugcaccgccaccggcgagcacagaagagagaagagaagcguggcccuggugccccacgugggcaugggccuggagaccagaaccgagaccuggaugagcagcgagggcgccuggaagcacgcccagagaaucgagaccugggugcugagacaccccggcuucaccaucauggccgccauccuggccuacaccaucggcaccaccuacuuccagagagugcugaucuucauccugcugaccgccgugacccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcaccccgccacccugagaaaguacugcaucgaggccaagcugaccaacaccaccaccgccagcagaugccccacccagggcgagcccagccugaacgaggagcaggacaagagauucgugugcaagcacagcaugguggacagaggcuggggcaacggcugcggccuguucggcaagggcggcaucgugaccugcgccauguucaccugcaagaagaacauggagggcaagaucgugcagcccgagaaccuggaguacaccaucgugaucaccccccacagcggcgaggagaacgccgugggcaacgacaccggcaagcacggcaaggagaucaaggugaccccccagagcagcaucaccgaggccgagcugaccggcuacggcaccgugaccauggagugcagccccagaaccggccuggacuucaacgagauggugcugcugcagauggagaacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucgugaucagagugcaguacgagggcgacggcagccccugcaagauccccuucgagaucauggaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugagcugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcguggugaucaccuggaucggcaugaacagcagaagcaccagccugagcgugagccuggugcuggugggcguggugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagcugcacaaccacaccuuccugaucgacggccccgagaccgccgagugccccaacgccaacagagccuggaacagccuggagguggaggacuacggcuucggcguguucaccaccaacaucuggcugaagcugaaggagagacaggacgccuucugcgacagcaagcugaugagcgccgccaucaaggacaacagagccgugcacgccgacaugggcuacuggaucgagagcgcccugaacgacaccuggaagaucgagaaggccagcuucaucgaggugaagagcugccacuggcccaagagccacacccuguggagcaacggcgugcuggagagcgagaugaucauccccaagaacuucgccggccccgugagccagcacaacuacagacccggcuaccagacccagaccgccggccccuggcaccugggcagacuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugaugaccaccaucggcaucacccugcugagccagagcaccauccccgagaccauccuggagcugaccgacgcccuggcccugggcaugauggugcugaagaucgugagaaacauggagaaguaccagcuggccgugaccaucauggccauccugugcgugcccaacgccgugauccugcagaacgccuggaaggugagcugcaccacccuggccguggugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugagaugggaggagcaggccgagaucagcggcagcagccccauccugagcaucaccaucagcgaggacggcagcaugagcaucaagaacgaggaggaggagcagacccugaccauccugaucagaaccggccugcuggugaucagcggccuguuccccgugagcauccccaucaccgccgccgccugguaccugugggaggugaagaagcagagagccggcgugcugugggacgugcccagccccccccccgugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacaagggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccagcaccggcaccaucggcgccgugagccuggacuucagccccggcaccagcggcagccccaucguggacaagaagggcaagguggugggccuguacggcaacggcguggugaccagaagcggcaccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccaucagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacuucgaguacaucaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagagugggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacagaguggccgccgagggcaucaacuacgccgacagaagauggugcuucgacggcgugaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagaaacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggacuucggccugggcagcaucaccacccagcagcccgagagcaacauccuggacaucgaccugagacccgccagcgccuggacccuguacgccguggccaccaccuucaucacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggaccccauccccuacgaccccaaguucgagaagcagcugggccaggugaugcugcuggugcugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccgccaacaccagaagaggcaccggcaacaccggcgagacccugggcgagaaguggaagaacagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaaccuggugacccccgagggcaaggugguggaccugggcugcggcagaggcggcuggagcuacuacugcggcggccugaagaacgugaaggaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccguggaggccggcagaacccugagagugcugaaccugguggagaacuggcugaacaacaacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccagcggcaacaucgugagcagcgugaacaugaucagcagaaugcugaucaacagauucaccaugagacacaagaaggccaccuacgagcccgacguggaccugggcagcggcaccagaaacaucggcaucgagagcgagacccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacgugauccccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcggcuucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacauggagggcgagcacaagaagcuggccgaggccaucuucaagcugaccuaccagaacaagguggugagagugcagagacccacccccagaggcaccgugauggacaucaucagcagaagagaccagagaggcagcggccagguggugaccuacggccugaacaccuucaccaacauggaggcccagcugaucagacagauggagggcgagggcguguucaagagcauccagcagcugaccgugaccgaggagaucgccgugaagaacuggcuggugagagugggcagagagagacugagcagaauggccaucagcggcgacgacugcguggugaagccccuggacgacagauucgccagcgcccugaccgcccugaacgacaugggcaaggugagaaaggacauccagcagugggagcccagcagaggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugagagagaccgccugccugggcaagagcuacgcccagauguggagccugauguacuuccacagaagagaccugagacuggccgccaacgccaucugcagcgccgugcccagccacugggugcccaccagcagaaccaccuggagcauccacgccacccacgaguggaugaccaccgaggacaugcugaccguguggaacagaguguggauccaggagaaccccuggauggaggacaagacccccguggagagcugggaggagauccccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 17579 - RNA, 9876 nt, Artificial Sequence
  derived and/or modified CDS sequence (opt4) from DENV-2__KC762655__SS-prME
accgccggcaucaucaucaugaugauccccaccgugauggccuuccaccugaccaccagaaacggcgagccccacaugaucgugagcagacaggagaagggcaagagccugcuguucaagaccgagaacggcgugaacaugugcacccugauggccauggaccugggcgagcugugcgaggacaccaucaccuacaacugcccccugcugagacagaacgagcccgaggacaucgacugcuggugcaacagcaccagcaccugggugaccuacggcaccugcaccgccaccggcgagcacagaagagagaagagaagcguggcccuggugccccacgugggcaugggccuggagaccagaaccgagaccuggaugagcagcgagggcgccuggaagcacgcccagagaaucgagaccugggugcugagacaccccggcuucaccaucauggccgccauccuggccuacaccaucggcaccaccuacuuccagagagugcugaucuucauccugcugaccgccgugacccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcaccccgccacccugagaaaguacugcaucgaggccaagcugaccaacaccaccaccgccagcagaugccccacccagggcgagcccagccugaacgaggagcaggacaagagauucgugugcaagcacagcaugguggacagaggcuggggcaacggcugcggccuguucggcaagggcggcaucgugaccugcgccauguucaccugcaagaagaacauggagggcaagguggugcagcccgagaaccuggaguacaccaucgugaucaccccccacagcggcgaggagaacgccgugggcaacgacaccggcaagcacggcaaggagaucaaggugaccccccagagcagcaucaccgaggccgagcugaccggcuacggcaccgugaccauggagugcagccccagaaccggccuggacuucaacgagauggugcugcugcagauggagaacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucgugaucagagugcaguacgagggcgacggcagccccugcaagauccccuucgagaucauggaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugagcugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccguguacggcgccgccuucagcggcgugagcuggaccaugaagauccugaucggcguggugaucaccuggaucggcaugaacagcagaagcaccagccugagcgugagccuggugcuggugggcguggugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaaggccuggggcaaggccaagaugcugagcaccgagcugcacaaccacaccuuccugaucgacggccccgagaccgccgagugccccaacaccaacagagccuggaacagccuggagguggaggacuacggcuucggcguguucaccaccaacaucuggcugaagcugaaggagagacaggacguguucugcgacagcaagcugaugagcgccgccaucaaggacaacaaggccgugcacgccgacaugggcuacuggaucgagagcgcccugaacgacaccuggaagaucgagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcagacuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugaugaccaccaucggcaucgugcugcugagccagagcaccauccccgagaccauccuggagcugaccgacgcccuggcccugggcaugauggugcugaagaucgugagaaacauggagaaguaccagcuggccgugaccaucauggccauccugugcgugcccaacgccgugauccugcagaacgccuggaaggugagcugcaccacccuggccguggugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugagaugggaggagcaggccgagaucagcggcagcagccccauccugagcaucaccaucagcgaggacggcagcaugagcaucaagaacgaggaggaggagcagacccugaccauccugaucagaaccggccugcuggugaucagcggccuguuccccgugagcauccccaucaccgccaccgccugguaccugugggaggugaagaagcagagagccggcgugcugugggacgugcccagccccccccccgugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacaagggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucguggacaagaagggcaagguggugggccuguacggcaacggcguggugaccagaagcggcaccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccaucagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacuucgaguacaucaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagagugggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacagaguggccgccgagggcaucaacuacgccgacagaagauggugcuucgacggcgugaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagaaacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggacuucggccugggcagcaucgccacccagcagcccgagagcaacauccuggacaucgaccugagacccgccagcgccuggacccuguacgccguggccaccaccuucaucacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggaccccauccccuacgaccccaaguucgagaagcagcugggccaggugaugcugcuggugcugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccgccaacaccagaagaggcaccggcaacaccggcgagacccugggcgagaaguggaagaacagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaaccuggugacccccgagggcaaggugguggaccugggcugcggcagaggcggcuggagcuacuacugcggcggccugaagaacgugaaggaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccguggaggccggcagaacccugagagugcugaaccugguggagaacuggcugaacaacaacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccagcggcaacaucgugagcagcgugaacaugaucagcagaaugcugaucaacagauucaccaugagacacaagaaggccaccuacgagcccgacguggaccugggcagcggcaccagaaacaucggcaucgagagcgagacccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacgugauccccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcggcuucugggagcugguggacaaggagagaagccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacauggagggcgagcacaagaagcuggccgaggccaucuucaagcugaccuaccagaacaagguggugagagugcagagacccacccccagaggcaucgugauggacaucaucagcagaagagaccagagaggcagcggccagguggugaccuacggccugaacaccuucaccaacauggaggcccagcugaucagacagauggagggcgagggcguguucaagagcauccagcagcugaccgugaccgaggagaucgccgugaagaacuggcuggccagagugggcagagagagacugagcagaauggccaucagcggcgacgacugcguggugaagccccuggacgacagauucgccagcgcccugaccgcccugaacgacaugggcaaggugagaaaggacauccagcagugggagcccagcagaggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugagagagaccgccugccugggcaagagcuacgcccagauguggagccugauguacuuccacagaagagaccugagacuggccgccaacgccaucugcagcgccgugcccagccacugggugcccaccagcagaaccaccuggagcauccacgccacccacgaguggaugaccaccgaggacaugcugaccguguggaacagaguguggauccaggagaaccccuggauggaggacaagacccccguggagagcugggaggagauccccuaccugggcaagagagaggaccaguggugcggcagccugaucggccugaccagcagagccaccugggccagaaacauccagaccgccaucaaccaggugagaagccugaucggcaacgaggaguacaccgacuacaugcccagcaugaagagauucagaagagaggaggaggaggccggcgugcugugguga

SEQ ID NO: 17580 - RNA, 9876 nt, Artificial Sequence
  derived and/or modified CDS sequence (opt4) from DENV-2__KC762656__SS-prME
accgccggcaucaucaucaugaugauccccaccgugauggccuuccaccugaccaccagaaacggcgagccccacaugaucgugagcagacaggagaagggcaagagccugcuguucaagaccgagaacggcgugaacaugugcacccugauggccauggaccugggcgagcugugcgaggacaccaucaccuacaacugcccccugcugagacagaacgagcccgaggacaucgacugcuggugcaacagcaccagcaccugggugaccuacggcaccugcaccgccaccggcgagcacagaagagagaagagaagcguggcccuggugccccacgugggcaugggccuggagaccagagccgagaccuggaugagcagcgagggcgccuggaagcacgcccagagaaucgagaccugggugcugagacaccccggcuucaccaucauggccgccauccuggccuacaccaucggcaccaccuacuuccagagagugcugaucuucauccugcugaccgccgugacccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcaccccgccacccugagaaaguacugcaucgaggccaagcugaccaacaccaccaccgccagcagaugccccacccagggcgagcccagccugaacgaggagcaggacaagagauucgugugcaagcacagcaugguggacagaggcuggggcaacggcugcggccuguucggcaagggcggcaucgugaccugcgccauguucaccugcaagaagaacauggagggcaagguggugcagcccgagaaccuggaguacaccaucgugaucaccccccacagcggcgaggagaacgccgugggcaacgacaccggcaagcacggcaaggagaucaaggugaccccccagagcagcaucaccgaggccgagcugaccggcuacggcaccgugaccauggagugcagccccagaaccggccuggacuucaacgagauggugcugcugcagauggagaacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucgugaucagagugcaguacgagggcgacggcagccccugcaagauccccuucgagaucauggaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugagcugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcaccaucuacggcgccgccuucagcggcgugagcuggaccaugaagauccugaucggcguggugaucaccuggaucggcaugaacagcagaagcaccagccugagcgugagccuggugcuggugggcguggugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaaggccuggggcaaggccaagaugcugagcaccgagcugcacaaccacaccuuccugaucgacggccccgagaccgccgagugccccaacaccaacagagccuggaacagccuggagguggaggacuacggcuucggcguguucaccaccaacaucuggcugaagcugaaggagagacaggacguguucugcgacagcaagcugaugagcgccgccaucaaggacaacagagccgugcacgccgacaugggcuacuggaucgagagcgcccugaacgacaccuggaagaucgagaaggccagcuucaucgaggugaagagcugccaguggcccaagagccacacccuguggagcaacggcgugcuggagagcgagaugaucauccccaagaacuucgccggccccgugagccagcacaacuacagacccggcuaccacacccagaccgccggccccuggcaccugggcagacuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugaugaccaccaucggcaucgugcugcugagccagagcaccauccccgagaccauccuggagcugaccgacgcccuggcccugggcaugauggugcugaagaucgugagaaacauggagaaguaccagcuggccgugaccaucauggccauccugugcgugcccaacgccgugauccugcagaacgccuggaaggugagcugcaccacccuggccguggugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugagaugggaggagcaggccgagaucagcggcagcagccccauccugagcaucaccaucagcgaggacggcagcaugagcaucaagaacgaggaggaggagcagacccugaccauccugaucagaaccggccugcugguggugagcggccuguuccccgugagcauccccaucaccgccgccgccugguaccugugggaggugaagaagcagagagccggcgugcugugggacgugcccagccccccccccgugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacaagggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucguggacaagaagggcaagguggugggccuguacggcaacggcguggugaccagaagcggcaccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccaucagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacuucgaguacaucaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagagugggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacagaguggccgccgagggcaucaacuacgccgacagaagauggugcuucgacggcgugaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagaaacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggacuucggccugggcagcaucgccacccagcagcccgagagcaacauccuggacaucgaccugagacccgccagcgccuggacccuguacgccguggccaccaccuucaucacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggaccccauccccuacgaccccaaguucgagaagcagcugggccaggugaugcugcuggugcugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccgccaacaccagaagaggcaccggcaacaccggcgagacccugggcgagaaguggaagaacagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaaccuggugacccccgagggcaaggugguggaccugggcugcggcagaggcggcuggagcuacuacugcggcggccugaagaacgugaaggaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccguggaggccggcagaacccugagagugcugaaccugguggagaacuggcugaacaacaacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccagcggcaacaucgugagcagcgugaacaugaucagcagaaugcugaucaacagauucaccaugagacacaagaaggccaccuacgagcccgacguggaccugggcagcggcaccagaaacaucggcaucgagagcgagacccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacgugauccccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcggcuucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacauggagggcgagcacaagaagcuggccgaggccaucuucaagcugaccuaccagaacaagguggugagagugcagagacccacccccagaggcaccgugauggacaucaucagcagaagagaccagagaggcagcggccagguggugaccuacggccugaacaccuucaccaacauggaggcccagcugaucagacagauggagggcgagggcguguucaagagcauccagcagcugaccgugaccgaggagaucgccgugaagaacuggcuggugagagugggcagagagagacugagcagaauggccaucagcggcgacgacugcguggugaagccccuggacgacagauucgccagcgcccugaccgcccugaacgacaugggcaaggugagaaaggacauccagcagugggagcccagcagaggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugagagagaccgccugccugggcaagagcuacgcccagauguggagccugauguacuuccacagaagagaccugagacuggccgccaacgccaucugcagcgccgugcccagccacugggugcccaccagcagaaccaccuggagcauccacgccacccacgaguggaugaccaccgaggacaugcugaccguguggaacagaguguggauccaggagaaccccuggauggaggacaagacccccguggagagcugggaggagauccccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 17581 - RNA, 9876 nt, Artificial Sequence
  derived and/or modified CDS sequence (opt4) from DENV-2__KC762673__SS-prME
accgccggcaucaucaucaugaugauccccaccgugauggccuuccaccugaccaccagaaacggcgagccccacaugaucgugagcagacaggagaagggcaagagccugcuguucaagaccgagaacggcgugaacaugugcacccugauggccauggaccugggcgagcugugcgaggacaccaucaccuacaacugcccccugcugagacagaacgagcccgaggacaucgacugcuggugcaacagcaccagcaccugggugaccuacggcaccugcaccgccaccggcgagcacagaagagagaagagaagcguggcccuggugccccacgugggcaugggccuggagaccagaaccgagaccuggaugagcagcgagggcgccuggaagcacgcccagagaaucgagaccugggugcugagacaccccggcuucaccaucauggccgccauccuggccuacaccaucggcaccacccacuuccagagagugcugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcaccccgccacccugagaaaguacugcaucgaggccaagcugaccaacaccaccaccgccagcagaugccccacccagggcgagcccagccugaacgaggagcaggacaagagauucgugugcaagcacagcaugguggacagaggcuggggcaacggcugcggccuguucggcaagggcggcaucgugaccugcgccauguucaccugcaagaagaacauggagggcaagaucgugcagcccgagaaccuggaguacaccaucgugaucaccccccacagcggcgaggagaacgccgugggcaacgacaccggcaagcacggcaaggagaucaaggugaccccccagagcagcaucaccgaggccgagcugaccggcuacggcaccgugaccauggagugcagccccagaaccggccuggacuucaacgagauggugcugcugcagauggagaacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucgugaucagagugcaguacgagggcgacggcagccccugcaagauccccuucgagaucauggaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugagcugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcguggugaucaccuggaucggcaugaacagcagaagcaccccccugagcgugagccuggugcuggugggcguggugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagcugcacaaccacaccuuccugaucgacggccccgagaccgccgagugccccaacaccaacagagccuggaacagccuggagguggaggacuacggcuucggcguguucaccaccaacaucuggcugaagcugaaggagagacaggacguguacugcgacagcaagcugaugagcgccgccaucaaggacaacagagccgugcacgccgacaugggcuacuggaucgagagcgcccugaacgacaccuggaagaucgagaaggccagcuucaucgaggugaagagcugcuacuggcccaagagccacacccuguggagcaacggcgugcuggagagcgagaugaucauccccaagaacuucgccggccccgugagccagcacaacuacagacccggcuaccacacccagaccgccggccccuggcaccugggcagacuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugaugaccaccaucggcaucgugcugcugagccagagcaccauccccgagaccauccuggagcugaccgacgcccuggcccugggcaugauggcccugaagaucgugagaaacauggagaaguaccagcuggccgugaccaucauggccauccugugcgugcccaacgccgugauccugcagaacgccuggaaggugagcugcaccacccuggccguggugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugagaugggaggagcaggccgagaucagcggcagcagccccauccugagcaucaccaucagcgaggacggcagcaugagcaucaagaacgaggaggaggagcagacccugaccauccugaucagaaccggccugcuggugaucagcggccuguuccccgugagcauccccaucaccgccgccgccugguaccugugggaggugaagaagcagagagccggcgugcugugggacgugcccagccccccccccgugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacaagggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucguggacaagaagggcaagguggugggccuguacggcaacggcguggugaccagaagcggcaccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucaaggccgagcacaccggcagagagaucguggaccugaugugccacgccaccuucaccaugagacugcugagccccaucagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacuucgaguacaucaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagagugggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacagaguggccgccgagggcaucaacuacgccgacagaagauggugcuucgacggcgugaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagaaacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggacuucggccugggcagcaucaccacccagcagcccgagagcaacauccuggacaucgaccugagacccgccagcgccuggacccuguacgccguggccaccaccuucaucacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggaccccauccccuacgaccccaaguucgagaagcagcugggccaggugaugcugcuggugcugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccgccaacaccagaagaggcaccggcaacaccggcgagacccugggcgagaaguggaagaacagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaaccuggugacccccgagggcaaggugguggaccugggcugcggcagaggcggcuggagcuacuacugcggcggccugaagaacgugaaggaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccguggaggccggcagaacccugagagugcugaaccugguggagaacuggcugaacaacaacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccagcggcaacaucgugagcagcgugaacaugaucagcagaaugcugaucaacagauucaccaugagacacaagaaggccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacagaaccugggccuaccacggcagcuacgagaccaagcagaccggcagcgccagcagcauggugaacggcguggugagacugcugaccaagcccugggacgugauccccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcggcuucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacauggagggcgagcacaagaagcuggccgaggccaucuucaagcugaccuaccagaacaagguggugagagugcagagacccacccccagaggcaccgugauggacaucaucagcagaagagaccagagaggcagcggccagguggugaccuacggccugaacaccuucaccaacauggaggcccagcugaucagacagauggagggcgagggcguguucaagagcauccagcagcugaccgugaccgaggagaucgccgugaagaacuggcuggugagagugggcagagagagacugagcagaauggccaucagcggcgacgacugcguggugaagccccuggacgacagauucgccagcgcccugaccgcccugaacgacaugggcaaggugagaaaggacauccagcagugggagcccagcagaggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugagagagaccgccugccugggcaagagcuacgcccagauguggagccugauguacuuccacagaagagaccugagacuggccgccaacgccaucugcagcgccgugcccagccacugggugcccaccagcagaaccaccuggagcauccacgccacccacgaguggaugaccaccgaggacaugcugaccguguggaacagaguguggauccaggagaaccccuggauggaggacaagacccccguggagagcugggaggagauccccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 17582 - RNA, 9876 nt, Artificial Sequence
  derived and/or modified CDS sequence (opt4) from DENV-2__KC762663__SS-prME
accgccggcaucaucaucaugaugauccccaccgugauggccuuccaccugaccaccagaaacggcgagccccacaugaucgugagcagacaggagaagggcaagagccugcuguucaagaccgagaacggcgugaacaugugcacccugauggccauggaccugggcgagcugugcgaggacaccaucaccuacaacugcccccugcugagacagaacgagcccgaggacaucgacugcuggugcaacagcaccagcaccugggugaccuacggcaccugcaccgccaccggcgagcacagaagagagaagagaagcguggcccuggugccccacgugggcaugggccuggagaccagaaccgagaccuggaugagcagcgagggcgccuggaagcacgcccagagaaucgagaccugggugcugagacaccccggcuucaccaucauggccgccauccuggccuacaccaucggcaccaccuacuuccagagagugcugaucuucauccugcugaccgccgugacccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcaccccgccacccugagaaaguacugcaucgaggccaagcugaccaacaccaccaccgccagcagaugccccacccagggcgagcccagccugaacgaggagcaggacaagagauucgugugcaagcacagcaugguggacagaggcuggggcaacggcugcggccuguucggcaagggcggcaucgugaccugcgccauguucaccugcaagaagaacauggagggcaagaucgugcagcccgagaaccuggaguacaccaucgugaucaccccccacagcggcgaggagaacgccgugggcaacgacaccggcaagcacggcaaggagaucaaggugaccccccagagcagcaucaccgaggccgagcugaccggcuacggcaccgugaccauggagugcagccccagaaccggccuggacuucaacgagauggugcugcugcagauggagaacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucgugaucagagugcaguacgagggcgacggcagccccugcaagauccccuucgagaucaccgaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugagcugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcguggugaucaccuggaucggcaugaacagcagaagcaccagccugagcgugagccuggugcuggugggcguggugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagcugcacaaccacaccuuccugaucgacggccccgagaccgccgagugccccaacgccaacagagccuggaacagccuggagguggaggacuacggcuucggcguguucaccaccaacaucuggcugaagcugaaggagagacaggacgccuucugcgacagcaagcugaugagcgccgccaucaaggacaacagagccgugcacgccgacaugggcuacuggaucgagagcgcccugaacgacaccuggaagaucgagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcagacuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugaugaccaccaucggcaucacccugcugagccagagcaccauccccgagaccauccuggagcugaccgacgcccuggcccugggcaugauggugcugaagaucgugagaaacauggagaaguaccagcuggccgugaccaucauggccauccugugcgugcccaacgccgugauccugcagaacgccuggaaggugagcugcaccacccuggccguggugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugagaugggaggagcaggccgagaucagcggcagcagccccauccugagcaucaccaucagcgaggacggcagcaugagcaucaagaacgaggaggaggagcagacccugaccauccugaucagaaccggccugcuggugaucagcggccuguuccccgugagcauccccaucaccgccgccgccugguaccugugggaggugaagaagcagagagccggcgugcugugggacgugcccagccccccccccguggagaaggccgagcuggaggacggcgccuacagaaucaagcagaagggcauccugggcuacagccagaucggcgccggcguguacaaggagggcaccuuccacaccauguggcacgugaccagaggcgccgugcugaugcacaagggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccagcaccggcaccaucggcgccgugagccuggacuucagccccggcaccagcggcagccccaucguggacaagaagggcaagguggugggccuguacggcaacggcguggugaccagaagcggcaccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccaucagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacuucgaguacaucaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagagugggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacagaguggccgccgagggcaucaacuacgccgacagaagauggugcuucgacggcgugaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagaaacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggacuucggccugggcagcaucaccacccagcagcccgagagcaacauccuggacaucgaccugagacccgccagcgccuggacccuguacgccguggccaccaccuucaucacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggaccccauccccuacgaccccaaguucgagaagcagcugggccaggugaugcugcuggugcugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccgccaacaccagaagaggcaccggcaacaccggcgagacccugggcgagaaguggaagaacagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaaccuggugacccccgagggcaaggugguggaccugggcugcggcagaggcggcuggagcuacuacugcggcggccugaagaacgugaaggaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccguggaggccggcagaacccugagagugcugaaccugguggagaacuggcugaacaacaacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccagcggcaacaucgugagcagcgugaacaugaucagcagaaugcugaucaacagauucaccaugagacacaagaaggccaccuacgagcccgacguggaccugggcagcggcaccagaaacaucggcaucgagagcgagacccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacgugauccccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcggcuucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacauggagggcgagcacaagaagcuggccgaggccaucuucaagcugaccuaccagaacaagguggugagagugcagagacccacccccagaggcaccgugauggacaucaucagcagaagagaccagagaggcagcggccagguggugaccuacggccugaacaccuucaccaacauggaggcccagcugaucagacagauggagggcgagggcguguucaagagcauccagcagcugaccgugaccgaggagaucgccgugaagaacuggcuggugaccgugggcagagagagacugagcagaauggccaucagcggcgacgacugcguggugaagccccuggacgacagauucgccagcgcccugaccgcccugaacgacaugggcaaggugagaaaggacauccagcagugggagcccagcagaggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugagagagaccgccugccugggcaagagcuacgcccagauguggagccugauguacuuccacagaagagaccugagacuggccgccaacgccaucugcagcgccgugcccagccacugggugcccaccagcagaaccaccuggagcauccacgccacccacgaguggaugaccaccgaggacaugcugaccguguggaacagaguguggauccaggagaaccccuggauggaggacaagacccccguggagagcugggaggagauccccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 17583 - RNA, 9876 nt, Artificial Sequence
  derived and/or modified CDS sequence (opt4) from DENV-2__KC762675__SS-prME
accgccggcaucaucaucaugaugauccccaccgugauggccuuccaccugaccaccagaaacggcgagccccacaugaucgugagcagacaggagaagggcaagagccugcuguucaagaccgagaacggcgugaacaugugcacccugauggccauggaccugggcgagcugugcgaggacaccaucaccuacaacugcccccugcugagacagaacgagcccgaggacaucgacugcuggugcaacagcaccagcaccugggugaccuacggcaccugcaccgccaccggcgagcacagaagagagaagagaagcguggcccuggugccccacgugggcaugggccuggagaccagaaccgagaccuggaugagcagcgagggcgccuggaagcacgcccagagaaucgagaccugggugcugagacaccccggcuucaccaucauggccgccauccuggccuacaccaucggcaccacccacuuccagagagugcugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcaccccgccacccugagaaaguacugcaucgaggccaagcugaccaacaccaccaccgccagcagaugccccacccagggcgagcccagccugaacgaggagcaggacaagagauucgugugcaagcacagcaugguggacagaggcuggggcaacggcugcggccuguucggcaagggcggcaucgugaccugcgccauguucaccugcaagaagaacauggagggcaagaucgugcagcccgagaaccuggaguacaccaucgugaucaccccccacagcggcgaggagaacgccgugggcaacgacaccggcaagcacggcaaggagaucaaggugaccccccagagcagcaucaccgaggccgagcugaccggcuacggcaccgugaccauggagugcagccccagaaccggccuggacuucaacgagauggugcugcugcagauggagaacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucgugaucagagugcaguacgagggcgacggcagccccugcaagauccccuucgagaucauggaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugagcugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcguggugaucaccuggaucggcaugaacagcagaagcaccagccugagcgugagccuggugcuggugggcguggugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagcugcacaaccacaccuuccugaucgacggccccgagaccgccgagugccccaacaccaacagagccuggaacagccuggagguggaggacuacggcuucggcguguucaccaccaacaucuggcugaagcugaaggagagacaggacguguacugcgacagcaagcugaugagcgccgccaucaaggacaacagagccgugcacgccgacaugggcuacuggaucgagagcgcccugaacgacaccuggaagaucgagaaggccagcuucaucgaggugaagagcugcuacuggcccaagagccacacccuguggagcaacggcgugcuggagagcgagaugaucauccccaagaacuucgccggccccgugagccagcacaacuacagacccggcuaccacacccagaccgccggccccuggcaccugggcagacuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugaugaccaccaucggcaucgugcugcugagccagagcaccauccccgagaccauccuggagcugaccgacgcccuggcccugggcaugauggcccugaagaucgugagaaacauggagaaguaccagcuggccgugaccaucauggccauccugugcgugcccaacgccgugauccugcagaacgccuggaaggugagcugcaccacccuggccguggugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugagaugggaggagcaggccgagaucagcggcagcagccccauccugagcaucaccaucagcgaggacggcagcaugagcaucaagaacgaggaggaggagcagacccugaccauccugaucagaaccggccugcuggugaucagcggccuguuccccgugagcauccccaucaccgccgccgccugguaccugugggaggugaagaagcagagagccggcgugcugugggacgugcccagccccccccccgugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacaagggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucguggacaagaagggcaagguggugggccuguacggcaacggcguggugaccagaagcggcaccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccaucagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacuucgaguacaucaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagagugggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacagaguggccgccgagggcaucaacuacgccgacagaagauggugcuucgacggcgugaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagaaacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggacuucggccugggcagcaucaccacccagcagcccgagagcaacauccuggacaucgaccugagacccgccagcgccuggacccuguacgccguggccaccaccuucaucacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggaccccauccccuacgaccccaaguucgagaagcagcugggccaggugaugcugcuggugcugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccgccaacaccagaagaggcaccggcaacaccggcgagacccugggcgagaaguggaagaacagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaaccuggugacccccgagggcaaggugguggaccugggcugcggcagaggcggcuggagcuacuacugcggcggccugaagaacgugaaggaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccguggaggccggcagaacccugagagugcugaaccugguggagaacuggcugaacaacaacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccagcggcaacaucgugagcagcgugaacaugaucagcagaaugcugaucaacagauucaccaugagacacaagaaggccaccuacgagcccgacguggaccugggcagcggcaccagaaacaucggcaucgagagcgagauccccaaccuggacaucaucggcaagagaaucgagaagauccagcaggagcacgagaccagcuggcacuacgaccaggaccaccccuacagaaccugggccuaccacggcagcuacgagaccaagcagaccggcagcgccagcagcauggugaacggcguggugagacugcugaccaagcccugggacgugauccccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcggcuucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagacgugagcaagaaggagggcggcgccauguacgccgacgacaccgccggcugggacaccagaaucacccuggaggaccugaagaaggaggagauggugaccaaccacauggagggcgagcacaagaagcuggccgaggccaucuucaagcugaccuaccagaacaagguggugagagugcagagacccacccccagaggcaccgugauggacaucaucagcagaagagaccagagaggcagcggccagguggugaccuacggccugaacaccuucaccaacauggaggcccagcugaucagacagauggagggcgagggcguguucaagagcauccagcagcugaccgugaccgaggagaucgccgugaagaacuggcuggugagagugggcagagagagacugagcagaauggccaucagcggcgacgacugcguggugaagccccuggacgacagauucgccagcgcccugaccgcccugaacgacaugggcaaggugagaaaggacauccagcagugggagcccagcagaggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugagagagaccgccugccugggcaagagcuacgcccagauguggagccugauguacuuccacagaagagaccugagacuggccgccaacgccaucugcagcgccgugcccagccacugggugcccaccagcagaaccaccuggagcauccacgccacccacgaguggaugaccaccgaggacaugcugaccguguggaacagaguguggauccaggagaaccccuggauggaggacaagacccccguggagagcugggaggagauccccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 17584 - RNA, 9876 nt, Artificial Sequence
  derived and/or modified CDS sequence (opt4) from DENV-2__KC762671__SS-prME
accgccggcaucaucaucaugaugauccccaccgugauggccuuccaccugaccaccagaaacggcgagccccacaugaucgugagcagacaggagaagggcaagagccugcuguucaagaccgagaacggcgugaacaugugcacccugauggccauggaccugggcgagcugugcgaggacaccaucaccuacaacugcccccugcugagacagaacgagcccgaggacaucgacugcuggugcaacagcaccagcaccugggugaccuacggcaccugcaccgccaccggcgagcacagaagagagaagagaagcguggcccuggugccccacgugggcaugggccuggagaccagaaccgagaccuggaugagcagcgagggcgccuggaagcacgcccagagaaucgagaccugggugcugagacaccccggcuucaccaucauggccgccauccuggccuacaccaucggcaccaccuacuuccagagagugcugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcaccccgccacccugagaaaguacugcaucgaggccaagcugaccaacaccaccaccgccagcagaugccccacccagggcgagcccagccugaacgaggagcaggacaagagauucgugugcaagcacagcaugguggacagaggcuggggcaacggcugcggccuguucggcaagggcggcaucgugaccugcgccauguucaccugcaagaagaacauggagggcaagaucgugcagcccgagaaccuggaguacaccaucgugaucaccccccacagcggcgaggagaacgccgugggcaacgacaccggcaagcacggcaaggagaucaaggugaccccccagagcagcaucaccgaggccgagcugaccggcuacggcaccgugaccauggagugcagccccagaaccggccuggacuucaacgagauggugcugcugcagauggagaacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucgugaucagagugcaguacgagggcgacggcagccccugcaagauccccuucgagaucauggaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugagcugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcguggugaucaccuggaucggcaugaacagcagaagcaccagccugagcgugagccuggugcuggugggcguggugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaaggccuggggcaaggccaagaugcugagcaccgagcugcacaaccacaccuuccugaucgacggccccgagaccgccgagugccccaacaccaacagagccuggaacagccuggagguggaggacuacggcuucggcguguucaccaccaacaucuggcugaagcugaaggagagacaggacguguucugcgacagcaagcugaugagcgccgccaucaaggacagcagagccgugcacgccgacaugggcuacuggaucgagagcgcccugaacgacaccuggaagaucgagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcagacuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugaugaccaccaucggcaucgugcugcugagccaggccaccauccccgagaccauccuggagcugaccgacgcccuggcccugggcaugauggugcugaagaucgugagaaacauggagaaguaccagcuggccgugaccaucauggccauccugugcgugcccaacgccgugauccugcagaacgccuggaaggugagcugcaccacccuggccguggugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugagaugggaggagcaggccgagaucagcggcagcagccccauccugagcaucaccaucagcgaggacggcagcaugagcaucaagaacgaggaggaggagcagacccugaccauccugaucagaaccggccugcuggugaucagcggccuguuccccgugagcauccccaucaccgccgccgccugguaccugugggaggugaagaagcagagagccggcgugcugugggacgugcccagccccccccccgugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacaagggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucguggacaagaagggcaagguggugggccuguacggcaacggcguggugaccagaagcggcaccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccaucagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacuucgaguacaucaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagagugggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacagaguggccgccgagggcaucaacuacgccgacagaagauggugcuucgacggcgugaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagaaacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggacuucggccugggcagcaucaccacccagcagcccgagagcaacauccuggacaucgaccugagacccgccagcgccuggacccuguacgccguggccaccaccuucaucacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggaccccauccccuacgaccccaaguucgagaagcagcugggccaggugaugcugcuggugcugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccgccaacaccagaagaggcaccggcaacaccggcgagacccugggcgagaaguggaagaacagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaaccuggugacccccgagggcaaggugguggaccugggcugcggcagaggcggcuggagcuacuacugcggcggccugaagaacgugaaggaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccguggaggccggcagaacccugagagugcugaaccugguggagaacuggcugaacaacaacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccagcggcaacaucgugagcagcgugaacaugaucagcagaaugcugaucaacagauucaccaugagacacaagaaggccaccuacgagcccgacguggaccugggcagcggcaccagaaacaucggcaucgagagcgagacccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacgugauccccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucgccagaaaggugagaagcaacgccgcccugggcgccaucuucaccgacgagaacaaguggaagagcgccagagaggccguggaggacagcggcuucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagacgugagcaugaaggagggcggcgccauguacgccgacgacaccgccggcugggacaccagaaucacccuggaggaccugaagaacgaggagauggugaccaaccacauggagggcgagcacaagaagcuggccgaggccaucuucaagcugaccuaccagaacaagguggugagagugcagagacccacccccagaggcaccgugauggacaucaucagcagaagagaccagagaggcagcggccagguggugaccuacggccugaacaccuucaccaacauggaggcccagcugaucagacagauggagggcgagggcguguucaagagcauccagcagcugaccgugaccgaggagaucgccgugaagaacuggcuggugagagugggcagagagagacugagcagaauggccaucagcggcgacgacugcguggugaagccccuggacgacagauucgccagcgcccugaccgcccugaacgacaugggcaaggugagaaaggacauccagcagugggagcccagcagaggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugagagagaccgccugccugggcaagagcuacgcccagauguggagccugauguacuuccacagaagagaccugagacuggccgccaacgccaucugcagcgccgugcccagccacugggugcccaccagcagaaccaccuggagcauccacgccacccacgaguggaugaccaccgaggacaugcugaccguguggaacagaguguggauccaggagaaccccuggauggaggacaagacccccguggagagcugggaggagauccccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 17585 - RNA, 9876 nt, Artificial Sequence
  derived and/or modified CDS sequence (opt4) from DENV-2__KC762664__SS-prME
accgccggcaucaucaucaugaugauccccaccgugauggccuuccaccugaccaccagaaacggcgagccccacaugaucgugagcagacaggagaagggcaagagccugcuguucaagaccgagaacggcgugaacaugugcacccugauggccauggaccugggcgagcugugcgaggacaccaucaccuacaacugcccccugcugagacagaacgagcccgaggacaucgacugcuggugcaacagcaccagcaccugggugaccuacggcaccugcaccgccaccggcgagcacagaagagagaagagaagcguggcccuggugccccacgugggcaugggccuggagaccagaaccgagaccuggaugagcagcgagggcgccuggaagcacgcccagagaaucgagaccugggugcugagacaccccggcuucaccaucauggccgccauccuggccuacaccaucggcaccaccuacuuccagagagugcugaucuucauccugcugaccgccgugacccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcaccccgccacccugagaaaguacugcaucgaggccaagcugaccaacaccaccaccgccagcagaugccccacccagggcgagcccagccugaacgaggagcaggacaagagauucgugugcaagcacagcaugguggacagaggcuggggcaacggcugcggccuguucggcaagggcggcaucgugaccugcgccauguucaccugcaagaagaacauggagggcaagaucgugcagcccgagaaccuggaguacaccaucgugaucaccccccacagcggcgaggagaacgccgugggcaacgacaccggcaagcacggcaaggagaucaaggugaccccccagagcagcaucaccgaggccgagcugaccggcuacggcaccgugaccauggagugcagccccagaaccggccuggacuucaacgagauggugcugcugcagauggagaacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucgugaucagagugcaguacgagggcgacggcagccccugcaagauccccuucgagaucaccgaccuggagaagagacacggccugggcagacugaucaccgugaaccccaucgugaccgagaaggacagccccgugaacaucgaggccgagccccccuucggcgacagcuacaucaucaucggcguggagcccggccagcugaagcugagcugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcguggugaucaccuggaucggcaugaacagcagaagcaccagccugagcgugagccuggugcuggugggcguggugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagcugcacaaccacaccuuccugaucgacggccccgagaccgccgagugccccaacgccaacagagccuggaacagccuggagguggaggacuacggcuucggcguguucaccaccaacaucuggcugaagcugaaggagagacaggacgccuucugcgacagcaagcugaugagcgccgccaucaaggacaacagagccgugcacgccgacaugggcuacuggaucgagagcgcccugaacgacaccuggaagaucgagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcagacuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugaugaccaccaucggcaucacccugcugagccagagcaccauccccgagaccauccuggagcugaccgacgcccuggcccugggcaugauggugcugaagaucgugagaaacauggagaaguaccagcuggccgugaccaucauggccauccugugcgugcccaacgccgugauccugcagaacgccuggaaggugagcugcaccacccuggccguggugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugagaugggaggagcaggccgagaucagcggcagcagccccauccugagcaucaccaucagcgaggacggcagcaugagcaucaagaacgaggaggaggagcagacccugaccauccugaucagaaccggccugcuggugaucagcggccuguuccccgugagcauccccaucaccgccgccgccugguaccugugggaggugaagaagcagagagccggcgugcugugggacgugcccagccccccccccguggagaaggccgagcuggaggacggcgccuacagaaucaagcagaagggcauccugggcuacagccagaucggcgccggcguguacaaggagggcaccuuccacaccauguggcacgugaccagaggcgccgugcugaugcacaagggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccagcaccggcaccaucggcgccgugagccuggacuucagccccggcaccagcggcagccccaucguggacaagaagggcaagguggugggccuguacggcaacggcguggugaccagaagcggcaccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccaucagagugcccaacuacaaccugaucaucauggacgaggcccacuucaccgaccccgccagcaucgccgccagaggcuacaucagcaccagaguggagaugggcaaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacuucgaguacaucaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagagugggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacagaguggccgccgagggcaucaacuacgccgacagaagauggugcuucgacggcgugaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagaaacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggacuucggccugggcagcaucaccacccagcagcccgagagcaacauccuggacaucgaccugagacccgccagcgccuggacccuguacgccguggccaccaccuucaucacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggaccccauccccuacgaccccaaguucgagaagcagcugggccaggugaugcugcuggugcugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccgccaacaccagaagaggcaccggcaacaccggcgagacccugggcgagaaguggaagaacagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaaccuggugacccccgagggcaaggugguggaccugggcugcggcagaggcggcuggagcuacuacugcggcggccugaagaacgugaaggaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccguggaggccggcagaacccugagagugcugaaccugguggagaacuggcugaacaacaacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccagcggcaacaucgugagcagcgugaacaugaucagcagaaugcugaucaacagauucaccaugagacacaagaaggccaccuacgagcccgacguggaccugggcagcggcaccagaaacaucggcaucgagagcgagacccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacgugauccccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcggcuucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacauggagggcgagcacaagaagcuggccgaggccaucuucaagcugaccuaccagaacaagguggugagagugcagagacccacccccagaggcaccgugauggacaucaucagcagaagagaccagagaggcagcggccagguggugaccuacggccugaacaccuucaccaacauggaggcccagcugaucagacagauggagggcgagggcguguucaagagcauccagcagcugaccgugaccgaggagaucgccgugaagaacuggcuggugaccgugggcagagagagacugagcagaauggccaucagcggcgacgacugcguggugaagccccuggacgacagauucgccagcgcccugaccgcccugaacgacaugggcaaggugagaaaggacauccagcagugggagcccagcagaggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugagagagaccgccugccugggcaagagcuacgcccagauguggagccugauguacuuccacagaagagaccugagacuggccgccaacgccaucugcagcgccgugcccagccacugggugcccaccagcagaaccaccuggagcauccacgccacccacgaguggaugaccaccgaggacaugcugaccguguggaacagaguguggauccaggagaaccccuggauggaggacaagacccccgugggcagcugggaggagauccccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 17586 - RNA, 9876 nt, Artificial Sequence
  derived and/or modified CDS sequence (opt4) from DENV-2__KC762674__SS-prME
accgccggcaucaucaucaugaugauccccaccgugauggccuuccaccugaccaccagaaacggcgagccccacaugaucgugagcagacaggagaagggcaagagccugcuguucaagaccgagaacggcgugaacaugugcacccugauggccauggaccugggcgagcugugcgaggacaccaucaccuacaacugcccccugcugagacagaacgagcccgaggacaucgacugcuggugcaacagcaccagcaccugggugaccuacggcaccugcaccgccaccggcgagcacagaagagagaagagaagcguggcccuggugccccacgugggcaugggccuggagaccagaaccgagaccuggaugagcagcgagggcgccuggaagcacgcccagagaaucgagaccugggugcugagacaccccggcuucaccaucauggccgccauccuggccuacaccaucggcaccacccacuuccagagagugcugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcaccccgccacccugagaaaguacugcaucgaggccaagcugaccaacaccaccaccgccagcagaugccccacccagggcgagcccagccugaacgaggagcaggacaagagauucgugugcaagcacagcaugguggacagaggcuggggcaacggcugcggccuguucggcaagggcggcaucgugaccugcgccauguucaccugcaagaagaacauggagggcaagaucgugcagcccgagaaccuggaguacaccaucgugaucaccccccacagcggcgaggagaacgccgugggcaacgacaccggcaagcacggcaaggagaucaaggugaccccccagagcagcaucaccgaggccgagcugaccggcuacggcaccgugaccauggagugcagccccagaaccggccuggacuucaacgagauggugcugcugcagauggagaacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucgugaucagagugcaguacgagggcgacggcagccccugcaagauccccuucgagaucauggaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugagcugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcguggugaucaccuggaucggcaugaacagcagaagcaccagccugagcgugagccuggugcuggugggcguggugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagcugcacaaccacaccuuccugaucgacggccccgagaccgccgagugccccaacaccaacagagccuggaacagccuggagguggaggacuacggcuucggcguguucaccaccaacaucuggcugaagcugaaggagagacaggacguguacugcgacagcaagcugaugagcgccgccaucaaggacaacagagccgugcacgccgacaugggcuacuggaucgagagcgcccugaacgacaccuggaagaucgagaaggccagcuucaucgaggugaagagcugcuacuggcccaagagccacacccuguggagcaacggcgugcuggagagcgagaugaucauccccaagaacuucgccggccccgugagccagcacaacuacagacccggcuaccacacccagaccgccggccccuggcaccugggcagacuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugaugaccaccaucggcaucgugcugcugagccagagcaccauccccgagaccauccuggagcugaccgacgcccuggcccugggcaugauggcccugaagaucgugagaaacauggagaaguaccagcuggccgugaccaucauggccauccugugcgugcccaacgccgugauccugcagaacgccuggaaggugagcugcaccacccuggccguggugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugagaugggaggagcaggccgagaucagcggcagcagccccauccugagcaucaccaucagcgaggacggcagcaugagcaucaagaacgaggaggaggagcagacccugaccauccugaucagaaccggccugcuggugaucagcggccuguuccccgugagcauccccaucaccgccgccgccugguaccugugggaggugaagaagcagagagccggcgugcugugggacgugcccagccccccccccgugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacaagggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucguggacaagaagggcaagguggugggccuguacggcaacggcguggugaccagaagcggcaccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccaucagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacuucgaguacaucaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagagugggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacagaguggccgccgagggcaucaacuacgccgacagaagauggugcuucgacggcgugaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagaaacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggacuucggccugggcagcaucaccacccagcagcccgagagcaacauccuggacaucgaccugagacccgccagcgccuggacccuguacgccguggccaccaccuucaucacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggaccccauccccuacgaccccaaguucgagaagcagcugggccaggugaugcugcuggugcugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccgccaacaccagaagaggcaccggcaacaccggcgagacccugggcgagaaguggaagaacagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaaccuggugacccccgagggcaaggugguggaccugggcugcggcagaggcggcuggagcuacuacugcggcggccugaagaacgugaaggaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccguggaggccggcagaacccugagagugcugaaccugguggagaacuggcugaacaacaacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccagcggcaacaucgugagcagcgugaacaugaucagcagaaugcugaucaacagauucaccaugagacacaagaaggccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacgugauccccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcggcuucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacauggagggcgagcacaagaagcuggccgaggccaucuucaagcugaccuaccagaacaagguggugagagugcagagacccacccccagaggcaccgugauggacaucaucagcagaagagaccagagaggcagcggccagguggugaccuacggccugaacaccuucaccaacauggaggcccagcugaucagacagauggagggcgagggcguguucaagagcauccagcagcugaccgugaccgaggagaucgccgugaagaacuggcuggugagagugggcagagagagacugagcagaauggccaucagcggcgacgacugcguggugaagccccuggacgacagauucgccagcgcccugaccgcccugaacgacaugggcaaggugagaaaggacauccagcagugggagcccagcagaggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugagagagaccgccugccugggcaagagcuacgcccagauguggagccugauguacuuccacagaagagaccugagacuggccgccaacgccaucugcagcgccgugcccagccacugggugcccaccagcagaaccaccuggagcauccacgccacccacgaguggaugaccaccgaggacaugcugaccguguggaacagaguguggauccaggagaaccccuggauggaggacaagacccccguggagagcugggaggagauccccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 17587 - RNA, 9876 nt, Artificial Sequence
  derived and/or modified CDS sequence (opt4) from DENV-2__KC762672__SS-prME
accgccggcaucaucaucaugaugauccccaccgugauggccuuccaccugaccaccagaaacggcgagccccacaugaucgugagcagacaggagaagggcaagagccugcuguucaagaccgagaacggcgugaacaugugcacccugauggccauggaccugggcgagcugugcgaggacaccaucaccuacaacugcccccugcugagacagaacgagcccgaggacaucgacugcuggugcaacagcaccagcaccugggugaccuacggcaccugcaccgccaccggcgagcacagaagagagaagagaagcguggcccuggugccccacgugggcaugggccuggagaccagaaccgagaccuggaugagcagcgagggcgccuggaagcacgcccagagaaucgagaccugggugcugagacaccccggcuucaccaucauggccgccauccuggccuacaccaucggcaccaccuacuuccagagagugcugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcaccccgccacccugagaaaguacugcaucgaggccaagcugaccaacaccaccaccgccagcagaugccccacccagggcgagcccagccugaacgaggagcaggacaagagauucgugugcaagcacagcaugguggacagaggcuggggcaacggcugcggccuguucggcaagggcggcaucgugaccugcgccauguucaccugcaagaagaacauggagggcaagaucgugcagcccgagaaccuggaguacaccaucgugaucaccccccacagcggcgaggagaacgccgugggcaacgacaccggcaagcacggcaaggagaucaaggugaccccccagagcagcaucaccgaggccgagcugaccggcuacggcaccgugaccauggagugcagccccagaaccggccuggacuucaacgagauggugcugcugcagauggagaacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucgugaucagagugcaguacgagggcgacggcagccccugcaagauccccuucgagaucauggaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugagcugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcguggugaucaccuggaucggcaugaacagcagaagcaccagccugagcgugagccuggugcuggugggcguggugacccuguaccugggcgugauggugcaggccgacagcggcugcguggugagcugggagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaaggccuggggcaaggccaagaugcugagcaccgagcugcacaaccacaccuuccugaucgacggccccgagaccgccgagugccccaacaccaacagagccuggaacagccuggagguggaggacuacggcuucggcguguucaccaccaacaucuggcugaagcugaaggagagacaggacguguucugcgacagcaagcugaugagcgccgccaucaaggacagcagagccgugcacgccgacaugggcuacuggaucgagagcgcccugaacgacaccuggaagaucgagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcagacuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugaugaccaccaucggcaucgugcugcugagccaggccaccauccccgagaccauccuggagcugaccgacgcccuggcccugggcaugauggugcugaagaucgugagaaacauggagaaguaccagcuggccgugaccaucauggccauccugugcgugcccaacgccgugauccugcagaacgccuggaaggugagcugcaccacccuggccguggugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugagaugggaggagcaggccgagaucagcggcagcagccccauccugagcaucaccaucagcgaggacggcagcaugagcaucaagaacgaggaggaggagcagacccugaccauccugaucagaaccggccugcuggugaucagcggccuguuccccgugagcauccccaucaccgccgccgccugguaccugugggaggugaagaagcagagagccggcgugcugugggacgugcccagccccccccccgugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacaagggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucguggacaagaagggcaagguggugggccuguacggcaacggcguggugaccagaagcggcaccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccaucagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacuucgaguacaucaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagagugggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacagaguggccgccgagggcaucaacuacgccgacagaagauggugcuucgacggcgugaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagaaacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggacuucggccugggcagcaucaccacccagcagcccgagagcaacauccuggacaucgaccugagacccgccagcgccuggacccuguacgccguggccaccaccuucaucacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggaccccauccccuacgaccccaaguucgagaagcagcugggccaggugaugcugcuggugcugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccgccaacaccagaagaggcaccggcaacgccggcgagacccugggcgagaaguggaagaacagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaaccuggugacccccgagggcaaggugguggaccugggcugcggcagaggcggcuggagcuacuacugcggcggccugaagaacgugaaggaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccguggaggccggcagaacccugagagugcugaaccugguggagaacuggcugaacaacaacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccagcggcaacaucgugagcagcgugaacaugaucagcagaaugcugaucaacagauucaccaugagacacaagaaggccaccuacgagcccgacguggaccugggcagcggcaccagaaacaucggcaucgagagcgagacccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacgugauccccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucgccagaaaggugagaagcaacgccgcccugggcgccaucuucaccgacgagaacaaguggaagagcgccagagaggccguggaggacagcggcuucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagacgugagcaugaaggagggcggcgccauguacgccgacgacaccgccggcugggacaccagaaucacccuggaggaccugaagaacgaggagauggugaccaaccacauggagggcgagcacaagaagcuggccgaggccaucuucaagcugaccuaccagaacaagguggugagagugcagagacccacccccagaggcaccgugauggacaucaucagcagaagagaccagagaggcagcggccagguggugaccuacggccugaacaccuucaccaacauggaggcccagcugaucagacagauggagggcgagggcguguucaagagcauccagcagcugaccgugaccgaggagaucgccgugaagaacuggcuggugagagugggcagagagagacugagcagaauggccaucagcggcgacgacugcguggugaagccccuggacgacagauucgccagcgcccugaccgcccugaacgacaugggcaaggugagaaaggacauccagcagugggagcccagcagaggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugagagagaccgccugccugggcaagagcuacgcccagauguggagccugauguacuuccacagaagagaccugagacuggccgccaacgccaucugcagcgccgugcccagccacugggugcccaccagcagaaccaccuggagcauccacgccacccacgaguggaugaccaccgaggacaugcugaccguguggaacagaguguggauccaggagaaccccuggauggaggacaagacccccguggagagcugggaggagauccccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 17588 - RNA, 9876 nt, Artificial Sequence
  derived and/or modified CDS sequence (opt4) from DENV-2__KC762667__SS-prME
accgccggcaucaucaucaugaugauccccaccgugauggccuuccaccugaccaccagaaacggcgagccccacaugaucgugagcagacaggagaagggcaagagccugcuguucaagaccgagaacggcgugaacaugugcacccugauggccauggaccugggcgagcugugcgaggacaccaucaccuacaacugcccccugcugagacagaacgagcccgaggacaucgacugcuggugcaacagcaccagcaccugggugaccuacggcaccugcaccgccaccggcgagcacagaagagagaagagaagcguggcccuggugccccacgugggcaugggccuggagaccagaaccgagaccuggaugagcagcgagggcgccuggaagcacgcccagagaaucgagaccugggugcugagacaccccggcuucaccaucauggccgccauccuggccuacaccaucggcaccaccuacuuccagagagugcugaucuucauccugcugaccgccgugacccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcaccccgccacccugagaaaguacugcaucgaggccaagcugaccaacaccaccaccgccagcagaugccccacccagggcgagcccagccugaacgaggagcaggacaagagauucgugugcaagcacagcaugguggacagaggcuggggcaacggcugcggccuguucggcaagggcggcaucgugaccugcgccauguucaccugcaagaagaacauggagggcaagaucgugcagcccgagaaccuggaguacaccaucgugaucaccccccacagcggcgaggagaacgccgugggcaacgacaccggcaagcacggcaaggagaucaaggugaccccccagagcagcaucaccgaggccgagcugaccggcuacggcaccgugaccauggagugcagccccagaaccggccuggacuucaacgagauggugcugcugcagauggagaacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucgugaucagagugcaguacgagggcgacggcagccccugcaagauccccuucgagaucauggaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugagcugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcguggugaucaccuggaucggcaugaacagcagaagcaccagccugagcgugagccuggugcuggugggcguggugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagcugcacaaccacaccuuccugaucgacggccccgagaccgccgagugccccaacgccaacagagccuggaacagccuggagguggaggacuacggcuucggcguguucaccaccaacaucuggcugaagcugaaggagagacaggacgccuucugcgacagcaagcugaugagcgccgccaucaaggacaacagagccgugcacgccgacaugggcuacuggaucgagagcgcccugaacgacaccuggaagaucgagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcagacuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugaugaccaccaucggcgugacccugcugagccagagcaccauccccgagaccauccuggagcugaccgacgcccuggcccugggcaugauggugcugaagaucgugagaaacauggagaaguaccagcuggccgugaccaucauggccauccugugcgugcccaacgccgugauccugcagaacgccuggaaggugagcugcaccacccuggccguggugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugagaugggaggagcaggccgagaucagcggcagcagccccauccugagcaucaccaucagcgaggacggcagcaugagcaucaagaacgaggaggaggagcagacccugaccauccugaucagaaccggccugcuggugaucagcggccuguuccccgugagcauccccaucaccgccgccgccugguaccugugggaggugaagaagcagagagccggcgugcugugggacgugcccagccccccccccgugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacaagggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccagcaccggcaccaucggcgccgugagccuggacuucagccccggcaccagcggcagccccaucguggacaagaagggcaagguggugggccuguacggcaacggcguggugaccagaagcggcaccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccaucagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacuucgaguacaucaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagagugggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacagaguggccgccgagggcaucaacuacgccgacagaagauggugcuucgacggcgugaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagaaacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggacuucggccugggcagcaucaccacccagcagcccgagagcaacauccuggacaucgaccugagacccgccagcgccuggacccuguacgccguggccaccaccuucaucacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggaccccauccccuacgaccccaaguucgagaagcagcugggccaggugaugcugcuggugcugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccgccaacaccagaagaggcaccggcaacaccggcgagacccugggcgagaaguggaagaacagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaaccuggugacccccgagggcaaggugguggaccugggcugcggcagaggcggcuggagcuacuacugcggcggccugaagaacgugaaggaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccguggaggccggcagaacccugagagugcugaaccugguggagaacuggcugaacaacaacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccagcggcaacaucgugagcagcgugaacaugaucagcagaaugcugaucaacagauucaccaugagacacaagaaggccaccuacgagcccgacguggaccugggcagcggcaccagaaacaucggcaucgagagcgagacccccaaccuggacaucaucggcaagagaaucgagaagaucaagagagagcacgagaccagcuggcacuacgaccaggaccaccccuacaagaccugggccuaccacggcagcuacgagaccaagcagaccggcagcgccagcagcauggugaacggcguggugagacugcugaccaagcccugggacgugauccccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcggcuucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacauggagggcgagcacaagaagcuggccgaggccaucuucaagcugaccuaccagaacaagguggugagagugcagagacccacccccagaggcaccgugauggacaucaucagcagaagagaccagagaggcagcggccagguggugaccuacggccugaacaccuucaccaacauggaggcccagcugaucagacagauggagggcgagggcguguucaagagcauccagcaccugaccgugaccgaggagaucgccgugaagaacuggcuggugagagugggcagagagagacugagcagaauggccaucagcggcgacgacugcguggugaagccccuggacgacagauucgccagcgcccugaccgcccugaacgacaugggcaaggugagaaaggacauccagcagugggagcccagcagaggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugagagagaccgccugccugggcaagagcuacgcccagauguggagccugauguacuuccacagaagagaccugagacuggccgccaacgccaucugcagcgccgugcccagccacugggugcccaccagcagaaccaccuggagcauccacgccacccacgaguggaugaccaccgaggacaugcugaccguguggaacagaguguggauccaggagaaccccuggauggaggacaagacccccguggagagcugggaggagauccccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 17589 - RNA, 9876 nt, Artificial Sequence
  derived and/or modified CDS sequence (opt4) from DENV-2__KC762659__SS-prME
accgccggcaucaucaucaugaugauccccaccgugauggccuuccaccugaccaccagaaacggcgagccccacaugaucgugagcagacaggagaagggcaagagccugcuguucaagaccgagaacggcgugaacaugugcacccugauggccauggaccugggcgagcugugcgaggacaccaucaccuacaacugcccccugcugagacagaacgagcccgaggacaucgacugcuggugcaacagcaccagcaccugggugaccuacggcaccugcaccgccaccggcgagcacagaagagagaagagaagcguggcccuggugccccacgugggcaugggccuggagaccagaaccgagaccuggaugagcagcgagggcgccuggaagcacgcccagagaaucgagaccugggugcugagacaccccggcuucaccaucauggccgccauccuggccuacaccaucggcaccaccuacuuccagagagugcugaucuucauccugcugaccgccgugacccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcaccccgccacccugagaaaguacugcaucgaggccaagcugaccaacaccaccaccgccagcagaugccccacccagggcgagcccagccugaacgaggagcaggacaagagauucgugugcaagcacagcaugguggacagaggcuggggcaacggcugcggccuguucggcaagggcggcaucgugaccugcgccauguucaccugcaagaagaacauggagggcaagguggugcagcccgagaaccuggaguacaccaucgugaucaccccccacagcggcgaggagaacgccgugggcaacgacaccggcaagcacggcaaggagaucaaggugaccccccagagcagcaucaccgaggccgagcugaccggcuacggcaccgugaccauggagugcagccccagaaccggccuggacuucaacgagauggugcugcugcagauggagaacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucgugaucagagugcaguacgagggcgacggcagccccugcaagauccccuucgagaucauggaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugagcugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcguggugaucaccuggaucggcaugaacagcagaagcaccagccugagcgugagccuggugcuggugggcguggugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagcugcacaaccacaccuuccugaucgacggccccgagaccgccgagugccccaacaccaacagagccuggaacagccuggagguggaggacuacggcuucggcguguucaccaccaacaucuggcugaagcugaaggagagacaggacguguucugcgacagcaagcugaugagcgccgccaucaaggacaacagagccgugcacgccgacaugggcuacuggauggagagcgcccugaacgacaccuggaagaucgagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcagacuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaagacugaccagcaaggagcugaugaugaccaccaucggcaucgugcugcugagccagagcaccauccccgagaccauccuggagcugaccgacgcccuggcccugggcaugauggugcugaagaucgugagaaagauggagaaguaccagcuggccgugaccaucauggccauccugugcgugcccaacgccgugauccugcagaacgccuggaaggugagcugcaccacccuggccguggugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugagaugggaggagcaggccgagaucagcggcagcagccccauccugagcaucaccaucagcgaggacggcagcaugagcaucaagaacgaggaggaggagcagacccugaccauccugaucagaaccggccugcuggugaucagcggccuguuccccgugagcauccccaucaccgccgccgccugguaccugugggaggugaagaagcagagagccggcgugcugugggacgugcccagccccccccccgugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacaagggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucguggacaagaagggcaagguggugggccuguacggcaacggcguggugaccagaagcggcaccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccaucagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacuucgaguacaucaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagagugggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacagaguggccgccgagggcaucaacuacgccgacagaagauggugcuucgacggcgugaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagaaacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggacuucggccugggcagcaucaccacccagcagagcgagagcaacauccuggacaucgaccugagacccgccagcgccuggacccuguacgccguggccaccaccuucaucacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggaccccauccccuacgaccccaaguucgagaagcagcugggccaggugaugcugcuggugcugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccgccaacaccagaagaggcaccggcaacaccggcgagacccugggcgagaaguggaagaacagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaaccuggugacccccgagggcaaggugguggaccugggcugcggcagaggcggcuggagcuacuacugcggcggccugaagaacgugaaggaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccguggaggccggcagaacccugagagugcugaaccugguggagaacuggcugaacaacaacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccagcggcaacaucgugagcagcgugaacaugaucagcagaaugcugaucaacagauucaccaugagacacaagaaggccaccuacgagcccgacguggaccugggcagcggcaccagaaacaucggcaucgagagcgagacccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacgugauccccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcggcuucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacauggagggcgagcacaagaagcuggccgaggccaucuucaagcugaccuaccagaacaagguggugagagugcagagacccacccccagaggcaccgugauggacaucaucagcagaagagaccagagaggcagcggccagguggugaccuacggccugaacaccuucaccaacauggaggcccagcugaucagacagauggagggcgagggcguguucaagagcauccagcagcugaccgccaccgaggagaucgccgugaagaacuggcuggugagagugggcagagagagacugagcagaauggccaucagcggcgacgacugcguggugaagccccuggacgacagauucgccagcgcccugaccgcccugaacgacaugggcaaggugagaaaggacauccagcagugggagcccagcagaggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugagagagaccgccugccugggcaagagcuacgcccagauguggagccugauguacuuccacagaagagaccugagacuggccgccaacgccaucugcagcgccgugcccagccacugggugcccaccagcagaaccaccuggagcauccacgccacccacgaguggaugaccaccgaggacaugcugaccguguggaacagaguguggauccaggagaaccccuggaucgaggacaagacccccguggagagcugggaggagauccccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 17590 - RNA, 9876 nt, Artificial Sequence
  derived and/or modified CDS sequence (opt4) from DENV-2__KC762657__SS-prME
accgccggcaucaucaucaugaugauccccaccgugaugguguuccaccugaccaccagaaacggcgagccccacaugaucgugagcagacaggagaagggcaagagccugcuguucaagaccgagaacggcgugaacaugugcacccugauggccauggaccugggcgagcugugcgaggacaccaucaccuacaacugcccccugcugagacagaacgagcccgaggacaucgacugcuggugcaacagcaccagcaccugggugaccuacggcaccugcaccgccaccggcgagcacagaagagagaagagaagcguggcccuggugccccacgugggcaugggccuggagaccagaaccgagaccuggaugagcagcgagggcgccuggaagcacgcccagagaaucgagaccugggugcugagacaccccggcuucaccaucauggccgccauccuggccuacaccaucggcaccaccuacuuccagagagugcugaucuucauccugcugaccgccgugacccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcaccccgccacccugagaaaguacugcaucgaggccaagcugaccaacaccaccaccgccagcagaugccccacccagggcgagcccagccugaacgaggagcaggacaagagauucgugugcaagcacagcaugguggacagaggcuggggcaacggcugcggccuguucggcaagggcggcaucgugaccugcgccauguucaccugcaagaagaacauggagggcaagguggugcagcccgagaaccuggaguacaccaucgugaucaccccccacagcggcgaggagaacgccgugggcaacgacaccggcaagcacggcaaggagaucaaggugaccccccagagcagcaucaccgaggccgagcugaccggcuacggcaccgugaccauggagugcagccccagaaccggccuggacuucaacgagauggugcugcugcagauggagaacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucgugaucagagugcaguacgagggcgacggcagccccugcaagauccccuucgagaucauggaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugagcugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcguggugaucaccuggaucggcaugaacagcagaagcaccagccugagcgugagccuggugcuggugggcguggugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagcugcacaaccacaccuuccugaucgacggccccgagaccgccgagugccccaacaccaacagagccuggaacagccuggagguggaggacuacggcuucggcguguucaccaccaacaucuggcugaagcugaaggagagacaggacguguucugcgacagcaagcugaugagcgccgccaucaaggacaacagagccgugcacgccgacaugggcuacuggauggagagcgcccugaacgacaccuggaagaucgagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcagacuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaagacugaccagcaaggagcugaugaugaccaccaucggcaucgugcugcugagccagagcaccauccccgagaccauccuggagcugaccgacgcccuggcccugggcaugauggugcugaagaucgugagaaagauggagaaguaccagcuggccgugaccaucauggccauccugugcgugcccaacgccgugauccugcagaacgccuggaaggugagcugcaccacccuggccguggugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugagaugggaggagcaggccgagaucagcggcagcagccccauccugagcaucaccaucagcgaggacggcagcaugagcaucaagaacgaggaggaggagcagacccugaccauccugaucagaaccggccugcuggugaucagcggccuguuccccgugagcauccccaucaccgccgccgccugguaccugugggaggugaagaagcagagagccggcgugcugugggacgugcccagccccccccccgugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacaagggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucguggacaagaagggcaagguggugggccuguacggcaacggcguggugaccagaagcggcaccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccaucagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacuucgaguacaucaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagagugggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacagaguggccgccgagggcaucaacuacgccgacagaagauggugcuucgacggcgugaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagaaacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggacuucggccugggcagcaucaccacccagcagagcgagagcaacauccuggacaucgaccugagacccgccagcgccuggacccuguacgccguggccaccaccuucaucacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggaccccauccccuacgaccccaaguucgagaagcagcugggccaggugaugcugcuggugcugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccgccaacaccagaagaggcaccggcaacaccggcgagacccugggcgagaaguggaagaacagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaaccuggugacccccgagggcaaggugguggaccugggcugcggcagaggcggcuggagcuacuacugcggcggccugaagaacgugaaggaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccguggaggccggcagaacccugagagugcugaaccugguggagaacuggcugaacaacaacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccagcggcaacaucgugagcagcgugaacaugaucagcagaaugcugaucaacagauucaccaugagacacaagaaggccaccuacgagcccgacguggaccugggcagcggcaccagaaacaucggcaucgagagcgagacccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacgugauccccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcggcuucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacauggagggcgagcacaagaagcuggccgaggccaucuucaagcugaccuaccagaacaagguggugagagugcagagacccacccccagaggcaccgugauggacaucaucagcagaagagaccagagaggcagcggccagguggugaccuacggccugaacaccuucaccaacauggaggcccagcugaucagacagauggagggcgagggcguguucaagagcauccagcaccugaccgccaccgaggagaucgccgugaagaacuggcuggugagagugggcagagagagacugagcagaauggccaucagcggcgacgacugcguggugaagccccuggacgacagauucgccagcgcccugaccgcccugaacgacaugggcaaggugagaaaggacauccagcagugggagcccagcagaggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugagagagaccgccugccugggcaagagcuacgcccagauguggagccugauguacuuccacagaagagaccugagacuggccgccaacgccaucugcagcgccgugcccagccacugggugcccaccagcagaaccaccuggagcauccacgccacccacgaguggaugaccaccgaggacaugcugaccguguggaacagaguguggauccaggagaaccccuggaucgaggacaagacccccguggagagcugggaggagauccccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 17591 - RNA, 9876 nt, Artificial Sequence
  derived and/or modified CDS sequence (opt4) from DENV-2__KC762666__SS-prME
accgccggcaucaucaucaugaugauccccaccgugauggccuuccaccugaccaccagaaacggcgagccccacaugaucgugagcagacaggagaagggcaagagccugcuguucaagaccgagaacggcgugaacaugugcacccugauggccauggaccugggcgagcugugcgaggacaccaucaccuacaacugcccccugcugagacagaacgagcccgaggacaucgacugcuggugcaacagcaccagcaccugggugaccuacggcaccugcaccgccaccggcgagcacagaagagagaagagaagcguggcccuggugccccacgugggcaugggccuggagaccagaaccgagaccuggaugagcagcgagggcgccuggaagcacgcccagagaaucgagaccugggugcugagacaccccggcuucaccaucauggccgccauccuggccuacaccaucggcaccaccuacuuccagagagugcugaucuucauccugcugaccgccgugacccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcaccccgccacccugagaaaguacugcaucgaggccaagcugaccaacaccaccaccgccagcagaugccccacccagggcgagcccagccugaacgaggagcaggacaagagauucgugugcaagcacagcaugguggacagaggcuggggcaacggcugcggccuguucggcaagggcggcaucgugaccugcgccauguucaccugcaagaagaacauggagggcaagaucgugcagcccgagaaccuggaguacaccaucgugaucaccccccacagcggcgaggagaacgccgugggcaacgacaccggcaagcacggcaaggagaucaaggugaccccccagagcagcaucaccgaggccgagcugaccggcuacggcaccgugaccauggagugcagccccagaaccggccuggacuucaacgagauggugcugcugcagauggagaacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucgugaucagagugcaguacgagggcgacggcagccccugcaagauccccuucgagaucauggaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugagcugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcguggugaucaccuggaucggcaugaacagcagaagcaccagccugagcgugagccuggugcuggugggcguggugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagcugcacaaccacaccuuccugaucgacggccccgagaccgccgagugccccaacgccaacagagccuggaacagccuggagguggaggacuacggcuucggcguguucaccaccaacaucuggcugaagcugaaggagagacaggacgccuucugcgacagcaagcugaugagcgccgccaucaaggacaacagagccgugcacgccgacaugggcuacuggaucgagagcgcccugaacgacaccuggaagaucgagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcagacuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugaugaccaccaucggcaucacccugcugagccagagcaccauccccgagaccauccuggagcugaccgacgcccuggcccugggcaugauggugcugaagaucgugagaaacauggagaaguaccagcuggccgugaccaucauggccauccugugcgugcccaacgccgugauccugcagaacgccuggaaggugagcugcaccacccuggccguggugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugagaugggaggagcaggccgagaucagcggcagcagccccauccugagcaucaccaucagcgaggacggcagcaugagcaucaagaacgaggaggaggagcagacccugaccauccugaucagaaccggccugcuggugaucagcggccuguuccccgugagcauccccaucaccgccgccgccugguaccugugggaggugaagaagcagagagccggcgugcugugggacgugcccagccccccccccgugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacaagggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccagcaccggcaccaucggcgccgugagccuggacuucagccccggcaccagcggcagccccaucguggacaagaagggcaagguggugggccuguacggcaacggcguggugaccagaagcggcaccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccaucagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacuucgaguacaucaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagagugggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacagaguggccgccgagggcaucaacuacgccgacagaagauggugcuucgacggcgugaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagaaacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggacuucggccugggcagcaucaccacccagcagcccgagagcaacauccuggacaucgaccugagacccgccagcgccuggacccuguacgccguggccaccaccuucaucacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggaccccauccccuacgaccccaaguucgagaagcagcugggccaggugaugcugcuggugcugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccgccaacaccagaagaggcaccggcaacaccggcgagacccugggcgagaaguggaagaacagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaaccuggugacccccgagggcaaggugguggaccugggcugcggcagaggcggcuggagcuacuacugcggcggccugaagaacgugaaggaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccguggaggccggcagaacccugagagugcugaaccugguggagaacuggcugaacaacaacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccagcggcaacaucgugagcagcgugaacaugaucagcagaaugcugaucaacagauucaccaugagacacaagaaggccaccuacgagcccgacguggaccugggcagcggcaccagaaacaucggcaucgagagcgagacccccaaccuggacaucaucggcaagagaaucgagaagaucaagagagagcacgagaccagcuggcacuacgaccaggaccaccccuacaagaccugggccuaccacggcagcuacgagaccaagcagaccggcagcgccagcagcauggugaacggcguggugagacugcugaccaagcccugggacgugauccccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcggcuucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacauggagggcgagcacaagaagcuggccgaggccaucuucaagcugaccuaccagaacaagguggugagagugcagagacccacccccagaggcaccgugauggacaucaucagcagaagagaccagagaggcagcggccagguggugaccuacggccugaacaccuucaccaacauggaggcccagcugaucagacagauggagggcgagggcguguucaagagcauccagcagcugaccgugaccgaggagaucgccgugaagaacuggcuggugagagugggcagagagagacugagcagaauggccaucagcggcgacgacugcguggugaagccccuggacgacagauucgccagcgcccugaccgcccugaacgacaugggcaaggugagaaaggacauccagcagugggagcccagcagaggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugagagagaccgccugccugggcaagagcuacgcccagauguggagccugauguacuuccacagaagagaccugagacuggccgccaacgccaucugcagcgccgugcccagccacugggugcccaccagcagaaccaccuggagcauccacgccacccacgaguggaugaccaccgaggacaugcugaccguguggaacagaguguggauccaggagaaccccuggauggaggacaagacccccguggagagcugggaggagauccccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 17592 - RNA, 9876 nt, Artificial Sequence
  derived and/or modified CDS sequence (opt4) from DENV-2__KC762677__SS-prME
accgccggcaucaucaucaugaugauccccaccgugauggccuuccaccugaccaccagaaacggcgagccccacaugaucgugagcagacaggagaagggcaagagccugcuguucaagaccgagaacggcgugaacaugugcacccugauggccauggaccugggcgagcugugcgaggacaccaucaccuacaacugcccccugcugagacagaacgagcccgaggacaucgacugcuggugcaacagcaccagcaccugggugaccuacggcaccugcaccgccaccggcgagcacagaagagagaagagaagcguggcccuggugccccacgugggcaugggccuggagaccagaaccgagaccuggaugagcagcgagggcgccuggaagcacgcccagagaaucgagaccugggugcugagacaccccggcuucaccaucauggccgccauccuggccuacaccaucggcaccacccacuuccagagagugcugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcaccccgccacccugagaaaguacugcaucgaggccaagcugaccaacaccaccaccgccagcagaugccccacccagggcgagcccagccugaacgaggagcaggacaagagauucgugugcaagcacagcaugguggacagaggcuggggcaacggcugcggccuguucggcaagggcggcaucgugaccugcgccauguucaccugcaagaagaacauggagggcaagaucgugcagcccgagaaccuggaguacaccaucgugaucaccccccacagcggcgaggagaacgccgugggcaacgacaccggcaagcacggcaaggagaucaaggugaccccccagagcagcaucaccgaggccgagcugaccggcuacggcaccgugaccauggagugcagccccagaaccggccuggacuucaacgagauggugcugcugcagauggagaacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucgugaucagagugcaguacgagggcgacggcagccccugcaagauccccuucgagaucauggaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugagcugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcguggugaucaccuggaucggcaugaacagcagaagcaccagccugagcgugagccuggugcuggugggcguggugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagcugcacaaccacaccuuccugaucgacggccccgagaccgccgagugccccaacaccaacagagccuggaacagccuggagguggaggacuacggcuucggcguguucaccaccaacaucuggcugaagcugaaggagagacaggacguguacugcgacagcaagcugaugagcgccgccaucaaggacaacagagccgugcacgccgacaugggcuacuggaucgagagcgcccugaacgacaccuggaagaucgagaaggccagcuucaucgaggugaagagcugcuacuggcccaagagccacacccuguggagcaacggcgugcuggagagcgagaugaucauccccaagaacuucgccggccccgugagccagcacaacuacagacccggcuaccacacccagaccgccggccccuggcaccugggcagacuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagacccaugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugaugaccaccaucggcaucgugcugcugagccagagcaccauccccgagaccauccuggagcugaccgacgcccuggcccugggcaugauggcccugaagaucgugagaaacauggagaaguaccagcuggccgugaccaucauggccauccugugcgugcccaacgccgugauccugcagaacgccuggaaggugagcugcaccacccuggccguggugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugagaugggaggagcaggccgagaucagcggcagcagccccauccugagcaucaccaucagcgaggacggcagcaugagcaucaagaacgaggaggaggagcagacccugaccauccugaucagaaccggccugcuggugaucagcggccuguuccccgugagcauccccaucaccgccgccgccugguaccugugggaggugaagaagcagagagccggcgugcugugggacgugcccagccccccccccgugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacaagggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucguggacaagaagggcaagguggugggccuguacggcaacggcguggugaccagaagcggcaccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccaucagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacuucgaguacaucaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagagugggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacagaguggccgccgagggcaucaacuacgccgacagaagauggugcuucgacggcgugaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagaaacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggacuucggccugggcagcaucaccacccagcagcccgagagcaacauccuggacaucgaccugagacccgccagcgccuggacccuguacgccguggccaccaccuucaucacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggaccccauccccuacgaccccaaguucgagaagcagcugggccaggugaugcugcuggugcugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccgccaacaccagaagaggcaccggcaacaccggcgagacccugggcgagaaguggaagaacagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaaccuggugacccccgagggcaaggugguggaccugggcugcggcagaggcggcuggagcuacuacugcggcggccugaagaacgugaaggaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccguggaggccggcagaacccugagagugcugaaccugguggagaacuggcugaacaacaacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccagcggcaacaucgugagcagcgugaacaugaucagcagaaugcugaucaacagauucaccaugagacacaagaaggccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacagaaccugggccuaccacggcagcuacgagaacaagcagaccggcagcgccagcagcauggugaacggcguggugagacugcugaccaagcccugggacgugauccccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagaaaggaguucaccagaaaggugagaagcaacgccgcccugggcgccaucuucaccgacgagaacaaguggaagagcgccagagaggccguggaggacagcggcuucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacauggagggcgagcacaagaagcuggccgaggccaucuucaagcugaccuaccagaacaagguggugagagugcagagacccacccccagaggcaccgugauggacaucaucagcagaagagaccagagaggcagcggccagguggugaccuacggccugaacaccuucaccaacauggaggcccagcugaucagacagauggagggcgagggcguguucaagagcauccagcagcugaccgugaccgaggagaucgccgugaagaacuggcuggugagagugggcagagagagacugagcagaauggccaucagcggcgacgacugcguggugaagccccuggacgacagauucgccagcgcccugaccgcccugaacgacaugggcaaggugagaaaggacauccagcagugggagcccagcagaggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugagagagaccgccugccugggcaagagcuacgcccagauguggagccugauguacuuccacagaagagaccugagacuggccgccaacgccaucugcagcgccgugcccagccacugggugcccaccagcagaaccaccuggagcauccacgccacccacgaguggaugaccaccgaggacaugcugaccguguggaacagaguguggauccaggagaaccccuggauggaggacaagacccccguggagagcugggaggagauccccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 17593 - RNA, 9876 nt, Artificial Sequence
  derived and/or modified CDS sequence (opt4) from DENV-2__KC762668__SS-prME
accgccggcaucaucaucauggugauccccaccgugauggccuuccaccugaccaccagaaacggcgagccccacaugaucgugagcagacaggagaagggcaagagccugcuguucaagaccgagaacggcgugaacaugugcacccugauggccauggaccugggcgagcugugcgaggacaccaucaccuacaacugcccccugcugagacagaacgagcccgaggacaucgacugcuggugcaacagcaccagcaccugggugaccuacggcaccugcaccgccaccggcgagcacagaagagagaagagaagcguggcccuggugccccacgugggcaugggccuggagaccagaaccgagaccuggaugagcagcgagggcgccuggaagcacgcccagagaaucgagaccugggugcugagacaccccggcuucaccaucauggccgccauccuggccuacaccaucggcaccaccuacuuccagagagugcugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcaccccgccacccugagaaaguacugcaucgaggccaagcugaccaacaccaccaccgccagcagaugccccacccagggcgagcccagccugaacgaggagcaggacaagagauucgugugcaagcacagcaugguggacagaggcuggggcaacggcugcggccuguucggcaagggcggcaucgugaccugcgccauguucaccugcaagaagaacauggagggcaagaucgugcagcccgagaaccuggaguacaccaucgugaucaccccccacagcggcgaggagaacgccgugggcaacgacaccggcaagcacggcaaggagaucaagaucaccccccagagcagcaucaccgaggccgagcugaccggcuacggcaccgugaccauggagugcagccccagaaccggccuggacuucaacgagauggugcugcugcagauggagaacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucgugaucagagugcaguacgagggcgacggcagccccugcaagauccccuucgagaucauggaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugagcugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcguggugaucaccuggaucggcaugaacagcagaagcaccagccugagcgugagccuggugcuggugggcguggugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaaggccuggggcaaggccaagaugcugagcaccgagcugcacaaccacaccuuccugaucgacggccccgagaccgccgagugccccaacaccaacagagccuggaacagccuggagguggaggacuacggcuucggcguguucaccaccaacaucuggcugaagcugaaggagagacaggacguguucugcgacagcaagcugaugagcgccgccaucaaggacaacagagccgugcacgccgacaugggcuacuggaucgagagcgcccugaacgacaccuggaagaucgagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcagacuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugaugaccaccaucggcaucgugcugcugagccagagcaccauccccgagaccauccuggagcugaccgacgcccuggcccugggcaugauggugcugaagaucgugagaaacauggagaaguaccagcuggccgugaccaucauggccauccugugcgugcccaacgccgugauccugcagaacgccuggaaggugagcugcaccacccuggccguggugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugagaugggaggagcaggccgagaucagcggcagcagccccauccugagcaucaccaucagcgaggacggcagcaugagcaucaagaacgaggaggaggagcagacccugaccauccugaucagaaccggccugcuggugaucagcggccuguuccccgugagcauccccaucaccgccgccgccugguaccugugggaggugaagaagcagagagccggcgugcugugggacgugcccagccccccccccgugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacaagggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaucaucggcgccgugagccuggacuucagccccggcaccagcggcagccccaucguggacaagaagggcaagguggugggccuguacggcaacggcguggugaccagaagcggcaccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccaucagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacuucgaguacaucaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagagugggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacagaguggccgccgagggcaucaacuacgccgacagaagauggugcuucgacggcgugaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagaaacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggacuucggccugggcagcaucaccacccagcagcuggagagcaacauccuggacaucgaccugagacccgccagcgccuggacccuguacgccguggccaccaccuucaucacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggaccccauccccuacgaccccaaguucgagaagcagcugggccaggugaugcugcuggugcugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccgccaacaccagaagaggcaccggcaacaccggcgagacccugggcgagaaguggaagaacagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaaccuggugacccccgagggcaaggugguggaccugggcugcggcagaggcggcuggagcuacuacugcggcggccugaagaacgugaaggaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccguggaggccggcagaacccugagagugcugaaccugguggagaacuggcugaacaacaacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccagcggcaacaucgugagcagcgugaacaugaucagcagaaugcugaucaacagauucaccaugagacacaagaaggccaccuacgagcccgacguggaccugggcagcggcaccagaaacaucggcaucgagagcgagacccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacgugauccccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcggcuucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacauggagggcgagcacaagagacuggccgaggccaucuucagacugaccuaccagaacaagguggugagagugcagagacccacccccagaggcaccgugauggacaucaucagcagaagagaccagagaggcagcggccagguggugaccuacggccugaacaccuucaccaacauggaggcccagcugaucagacagauggagggcgagggcguguucaagagcauccagcaccugaccgugaccgaggagaucgccgugaagaacuggcuggccagagugggcagagagagacugagcagaauggccaucagcggcgacgacugcguggugaagccccuggacgacagauucgccagcgcccugaccgcccugaacgacaugggcaaggugagaaaggacauccagcagugggagcccagcagaggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugagagagaccgccugccugggcaagagcuacgcccagauguggagccugauguacuuccacagaagagaccugagacuggccgccaacgccaucugcagcgccgugcccagccacugggugcccaccagcagaaccaccuggagcauccacgccacccacgaguggaugaccaccgaggacaugcugaccguguggaacagaguguggauccaggagaaccccuggauggaggacaagacccccguggagagcugggaggagauccccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 17594 - RNA, 9876 nt, Artificial Sequence
  derived and/or modified CDS sequence (opt4) from DENV-2__KC762678__SS-prME
accgccggcaucaucaucaugaugauccccaccgugauggccuuccaccugaccaccagaaacggcgagccccacaugaucgugagcagacaggagaagggcaagagccugcuguucaagaccgagaacggcgugaacaugugcacccugauggccauggaccugggcgagcugugcgaggacaccaucaccuacaacugcccccugcugagacagaacgagcccgaggacaucgacugcuggugcaacagcaccagcaccugggugaccuacggcaccugcaccgccaccggcgagcacagaagagagaagagaagcguggcccuggugccccacgugggcaugggccuggagaccagaaccgagaccuggaugagcagcgagggcgccuggaagcacgcccagagaaucgagaccugggugcugagacaccccggcuucaccaucauggccgccauccuggccuacaccaucggcaccaccuacuuccagagaauccugaucuucauccugcugaccgccgugacccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcaccccgccacccugagaaaguacugcaucgaggccaagcugaccaacaccaccaccgccagcagaugccccacccagggcgagcccagccugaacgaggagcaggacaagagauucgugugcaagcacagcaugguggacagaggcuggggcaacggcugcggccuguucggcaagggcggcaucgugaccugcgccauguucaccugcaagaagaacauggagggcaagaucgugcagcccgagaaccuggaguacaccaucgugaucaccccccacagcggcgaggagaacgccgugggcaacgacaccggcaagcacggcaaggagaucaaggugaccccccagagcagcaucaccgaggccgagcugaccggcuacggcaccgugaccauggagugcagccccagaaccggccuggacuucaacgagauggugcugcugcagauggagaacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucgugaucagagugcaguacgagggcgacggcagccccugcaagauccccuucgagaucauggaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugagcugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcguggugaucaccuggaucggcaugaacagcagaagcaccagccugagcgugagccuggugcuggugggcguggugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagcugcacaaccacaccuuccugaucgacggccccgagaccgccgagugccccaacgccaacagagccuggaacagccuggagguggaggacuacggcuucggcguguucaccaccaacaucuggcugaagcugaaggagagacaggacgccuucugcgacagcaagcugaugagcgccgccaucaaggacaacagagccgugcacgccgacaugggcuacuggaucgagagcgcccugaacgacaccuggaagaucgagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcagacuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugguggccgugagcuucgugacccugaucaccggcaacaugagcuucagagaccugggcagagugauggugauggugggcgccaccaugaccgacgacaucggcaucggcgugaccuaccuggcccugcuggccgccuucaaggugagacccaccuucgccgccggccugcugcugagaaagcugaccagcaaggagcugaugaugaccaccaucggcaucacccugcugagccagagcaccauccccgagaccauccuggagcugaccgacgcccuggcccugggcaugauggugcugaagaucgugagaaacauggagaaguaccagcuggccgugaccaucauggccauccugugcgugcccaacgccgugauccugcagaacgccuggaaggugagcugcaccacccuggccguggugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugagaugggaggagcaggccgagaucagcggcagcagccccauccugagcaucaccaucagcgaggacggcagcaugagcaucaagaacgaggaggaggagcagacccugaccauccugaucagaaccggccugcuggugaucagcggccuguuccccgugagcauccccaucaccgccgccgccugguaccugugggaggugaagaagcagagagccggcgugcugugggacgugcccagccccccccccgugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacaagggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccagcaccggcaccaucggcgccgugagccuggacuucagccccggcaccagcggcagccccaucguggacaagaagggcaagguggugggccuguacggcaacggcguggugaccagaagcggcaccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccaucagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacaucaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagagugggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacagaguggccgccgagggcaucaacuacgccgacagaagauggugcuucgacggcgugaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggugagaaacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcgugggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggacuucggccugggcagcaucaccacccagcagcccgagagcaacauccuggacaucgaccugagacccgccagcgccuggacccuguacgccguggccaccaccuucaucacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagaaccgccgccggcaucaugaagaaccccaccguggacggcaucaccgugaucgaccuggaccccauccccuacgaccccaaguucgagaagcagcugggccaggugaugcugcuggugcugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccgccaacaccagaagaggcaccggcaacaccggcgagacccugggcgagaaguggaagaacagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaaccuggugacccccgagggcaaggugguggaccugggcugcggcagaggcggcuggagcuacuacugcggcggccugaagaacgugaaggaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccguggaggccggcagaacccugagagugcugaaccugguggagaacuggcugaacaacaacacccaguucugcaucaaggugcugagccccuacaugcccagcgugaucgagaagauggaggcccugcagagaaaguacggcggcgcccuggugagaaacccccugagcagaaacagcacccacgagauguacugggugagcaacgccagcggcaacaucgugagcagcgugaacaugaucagcagaaugcugaucaacagauucaccaugagacacaagaaggccaccuacgagcccgacguggaccugggcagcggcaccagaaacaucggcaucgagagcgagacccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacgugauccccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcggcuucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacauggagggcgagcacaagaagcuggccgaggccaucuucaagcugaccuaccagaacaagguggugagagugcagagacccacccccagaggcaccgugauggacaucaucagcagaagagaccagagaggcagcggccagguggugaccuacggccugaacaccuucaccaacauggaggcccagcugaucagacagauggagggcgagggcguguucaagagcauccagcagcugaccgugaccgaggagaucgccgugaagaacuggcuggugaccgugggcagagagagacugagcagaauggccaucagcggcgacgacugcguggugaagccccuggacgacagauucgccagcgcccugaccgcccugaacgacaugggcaaggugagaaaggacauccagcagugggagcccagcagaggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugagagagaccgccugccugggcaagagcuacgcccagauguggagccugauguacuuccacagaagagaccugagacuggccgccaacgccaucugcagcgccgugcccagccacugggugcccaccagcagaaccaccuggagcauccacgccacccacgaguggaugaccaccgaggacaugcugaccguguggaacagaguguggauccaggagaaccccuggauggaggacaagacccccguggagagcugggaggagauccccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 17595 - RNA, 9876 nt, Artificial Sequence
  derived and/or modified CDS sequence (opt4) from DENV-2__KC762679__SS-prME
accgccggcaucaucaucaugaugauccccaccgugauggccuuccaccugaccaccagaaacggcgagccccacaugaucgugagcagacaggagaagggcaagagccugcuguucaagaccgagaacggcgugaacaugugcacccugauggccauggaccugggcgagcugugcgaggacaccaucaccuacaacugcccccugcugagacagaacgagcccgaggacaucgacugcuggugcaacagcaccagcaccugggugaccuacggcaccugcaccgccaccggcgagcacagaagagagaagagaagcguggcccuggugccccacgugggcaugggccuggagaccagaaccgagaccuggaugagcagcgagggcgccuggaagcacgcccagagaaucgagaccugggugcugagacaccccggcuucaccaucauggccgccauccuggccuacaccaucggcaccaccuacuuccagagagugcugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcaccccgccacccugagaaaguacugcaucgaggccaagcugaccaacaccaccaccgccagcagaugccccacccagggcgagcccagccugaacgaggagcaggacaagagauucgugugcaagcacagcaugguggacagaggcuggggcaacggcugcggccuguucggcaagggcggcaucgugaccugcgccauguucaccugcaagaagaacauggagggcaagaucgugcagcccgagaaccuggaguacaccaucgugaucaccccccacagcggcgaggagaacgccgugggcaacgacaccggcaagcacggcaaggagaucaaggugaccccccagagcagcaucaccgaggccgagcugaccggcuacggcaccgugaccauggagugcagccccagaaccggccuggacuucaacgagauggugcugcugcagauggagaacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucgugaucagagugcaguacgagggcgacggcagccccugcaagauccccuucgagaucauggaccuggagaagagauacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcguggugaucaccuggaucggcaugaacagcagaagcaccagccugagcgugagccuggugcuggugggcguggugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaaggccuggggcaaggccaagaugcugagcaccgagcugcacaaccacaccuuccugaucgacggccccgagaccgccgagugccccaacaccaacagagccuggaacagccuggagguggaggacuacggcuucggcguguucaccaccaacaucuggcugaagcugaaggagagacaggacguguucugcgacagcaagcugaugagcgccgccaucaaggacagcagagccgugcacgccgacaugggcuacuggaucgagagcgcccugaacgacaccuggaagaucgagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcagacuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugaugaccaccaucggcaucgugcugcugagccaggccaccauccccgagaccauccuggagcugaccgacgcccuggcccugggcaugauggugcugaagaucgugagaaacauggagaaguaccagcuggccgugaccaucauggccauccugugcgugcccaacgccgugauccugcagaacgccuggaaggugagcugcaccacccuggccguggugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugagaugggaggagcaggccgagaucagcggcagcagccccauccugagcaucaccaucagcgaggacggcagcaugagcaucaagaacgaggaggaggagcagacccugaccauccugaucagaaccggccugcuggugaucagcggccuguuccccgugagcauccccaucaccgccgccgccugguaccugugggaggugaagaagcagagagccggcgugcugugggacgugcccagccccccccccgugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacaagggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucguggacaagaagggcaagguggugggccuguacggcaacggcguggugaccagaagcggcaccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccaucagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacaucaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagagugggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacagaguggccgccgagggcaucaacuacgccgacagaagauggugcuucgacggcgugaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagaaacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggacuucggccugggcagcaucaccacccagcagcccgagagcaacauccuggacaucgaccugagacccgccagcgccuggacccuguacgccguggccaccaccuucaucacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggaccccauccccuacgaccccaaguucgagaagcagcugggccaggugaugcugcuggugcugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccgccaacaccagaagaggcaccggcaacaccggcgagacccugggcgagaaguggaagaacagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaaccuggugacccccgagggcaaggugguggaccugggcugcggcagaggcggcuggagcuacuacugcggcggccugaagaacgugaaggaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccguggaggccggcagaacccugagagugcugaaccugguggagaacuggcugaacaacaacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccagcggcaacaucgugagcagcgugaacaugaucagcagaaugcugaucaacagauucaccaugagacacaagaaggccaccuacgagcccgacguggaccugggcagcggcaccagaaacaucggcaucgagagcgagacccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacgugauccccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcggcuucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagacgugagcaugaaggagggcggcgccauguacgccgacgacaccgccggcugggacaccagaaucacccuggaggaccugaagaacgaggagauggugaccaaccacauggagggcgagcacaagaagcuggccgaggccaucuucaagcugaccuaccagaacaagguggugagagugcagagacccacccccagaggcaccgugauggacaucaucagcagaagagaccagagaggcagcggccagguggugaccuacggccugaacaccuucaccaacauggaggcccagcugaucagacagauggagggcgagggcguguucaagagcauccagcagcugaccgugaccgaggagaucgccgugaagaacuggcuggugagagugggcagagagagacugagcagaauggccaucagcggcgacgacugcguggugaagccccuggacgacagauucgccagcgcccugaccgcccugaacgacaugggcaaggugagaaaggacauccagcagugggagcccagcagaggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugagagagaccgccugccugggcaagagcuacgcccagauguggagccugauguacuuccacagaagagaccugagacuggccgccaacgccaucugcagcgccgugcccagccacugggugcccaccagcagaaccaccuggagcauccacgccacccacgaguggaugaccaccgaggacaugcugaccguguggaacagaguguggauccaggagaaccccuggauggaggacaagacccccguggagagcugggaggagauccccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 17596 - RNA, 9876 nt, Artificial Sequence
  derived and/or modified CDS sequence (opt4) from DENV-2__KC762680__SS-prME
accgccggcaucaucaucaugaugauccccaccgugauggccuuccaccugaccaccagaaacggcgagccccacaugaucgugagcagacaggagaagggcaagagccugcuguucaagaccgagaacggcgugaacaugugcacccugauggccauggaccugggcgagcugugcgaggacaccaucaccuacaacugcccccugcugagacagaacgagcccgaggacaucgacugcuggugcaacagcaccagcaccugggugaccuacggcaccugcaccgccaccggcgagcacagaagagagaagagaagcguggcccuggugccccacgugggcaugggccuggagaccagaaccgagaccuggaugagcagcgagggcgccuggaagcacgcccagagaaucgagaccugggugcugagacaccccggcuucaccaucauggccgccauccuggccuacaccaucggcaccaccuacuuccagagagugcugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcaccccgccacccugagaaaguacugcaucgaggccaagcugaccaacaccaccaccgccagcagaugccccacccagggcgagcccagccugaacgaggagcaggacaagagauucgugugcaagcacagcaugguggacagaggcuggggcaacggcugcggccuguucggcaagggcggcaucgugaccugcgccauguucaccugcaagaagaacauggagggcaagaucgugcagcccgagaaccuggaguacaccaucgugaucaccccccacagcggcgaggagaacgccgugggcaacgacaccggcaagcacggcaaggagaucaaggugaccccccagagcagcaucaccgaggccgagcugaccggcuacggcaccgugaccauggagugcagccccagaaccggccuggacuucaacgagauggugcugcugcagauggagaacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucgugaucagagugcaguacgagggcgacggcagccccugcaagauccccuucgagaucauggaccuggagaagagauacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcguggugaucaccuggaucggcaugaacagcagaagcaccagccugagcgugagccuggugcuggugggcguggugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaaggccuggggcaaggccaagaugcugagcaccgagcugcacaaccacaccuuccugaucgacggccccgagaccgccgagugccccaacaccaacagagccuggaacagccuggagguggaggacuacggcuucggcguguucaccaccaacaucuggcugaagcugaaggagagacaggacguguucugcgacagcaagcugaugagcgccgccaucaaggacagcagagccgugcacgccgacaugggcuacuggaucgagagcgcccugaacgacaccuggaagaucgagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcagacuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugaugaccaccaucggcaucgugcugcugagccaggccaccauccccgagaccauccuggagcugaccgacgcccuggcccugggcaugauggugcugaagaucgugagaaacauggagaaguaccagcuggccgugaccaucauggccauccugugcgugcccaacgccgugauccugcagaacgccuggaaggugagcugcaccacccuggccguggugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugagaugggaggagcaggccgagaucagcggcagcagccccauccugagcaucaccaucagcgaggacggcagcaugagcaucaagaacgaggaggaggagcagacccugaccauccugaucagaaccggccugcuggugaucagcggccuguuccccgugagcauccccaucaccgccgccgccugguaccugugggaggugaagaagcagagagccggcgugcugugggacgugcccagccccccccccgugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacaagggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucguggacaagaagggcaagguggugggccuguacggcaacggcguggugaccagaagcggcaccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccaucagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacuucgaguacaucaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagagugggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacagaguggccgccgagggcaucaacuacgccgacagaagauggugcuucgacggcgugaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagaaacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggacuucggccugggcagcaucaccacccagcagcccgagagcaacauccuggacaucgaccugagacccgccagcgccuggacccuguacgccguggccaccaccuucaucacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggaccccauccccuacgaccccaaguucgagaagcagcugggccaggugaugcugcuggugcugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccgccaacaccagaagaggcaccggcaacaccggcgagacccugggcgagaaguggaagaacagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaaccuggugacccccgagggcaaggugguggaccugggcugcggcagaggcggcuggagcuacuacugcggcggccugaagaacgugaaggaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccguggaggccggcagaacccugagagugcugaaccugguggagaacuggcugaacaacaacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccagcggcaacaucgugagcagcgugaacaugaucagcagaaugcugaucaacagauucaccaugagacacaagaaggccaccuacgagcccgacguggaccugggcagcggcaccagaaacaucggcaucgagagcgagacccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacgugauccccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcggcuucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagacgugagcaugaaggagggcggcgccauguacgccgacgacaccgccggcugggacaccagaaucacccuggaggaccugaagaacgaggagauggugaccaaccacauggagggcgagcacaagaagcuggccgaggccaucuucaagcugaccuaccagaacaagguggugagagugcagagacccacccccagaggcaccgugauggacaucaucagcagaagagaccagagaggcagcggccagguggugaccuacggccugaacaccuucaccaacauggaggcccagcugaucagacagauggagggcgagggcguguucaagagcauccagcagcugaccgugaccgaggagaucgccgugaagaacuggcuggugagagugggcagagagagacugagcagaauggccaucagcggcgacgacugcguggugaagccccuggacgacagauucgccagcgcccugaccgcccugaacgacaugggcaaggugagaaaggacauccagcagugggagcccagcagaggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugagagagaccgccugccugggcaagagcuacgcccagauguggagccugauguacuuccacagaagagaccugagacuggccgccaacgccaucugcagcgccgugcccagccacugggugcccaccagcagaaccaccuggagcauccacgccacccacgaguggaugaccaccgaggacaugcugaccguguggaacagaguguggauccaggagaaccccuggauggaggacaagacccccguggagagcugggaggagauccccuaccugggcaagagagaggaccaguggugcggcagccugaucggccugaccagcagagccaccugggccaagaacauccagaccgccaucaaccaggugagaagccugaagggcaacgaggaguacaccgacuacaugcccagcaugaagagauucagaagagaggagggcgaggccggcgugcugugguga

SEQ ID NO: 17597 - RNA, 9876 nt, Artificial Sequence
  derived and/or modified CDS sequence (opt4) from DENV-2__JQ955624__SS-prME
accgccggcgugaucaucaugcugauccccaccgccauggccuuccaccugaccaccagaaacggcgagccccacaugaucgugagcagacaggagaagggcaagagccugcuguucaagaccgaggacggcgugaacaugugcacccugauggccauggaccugggcgagcugugcgaggacaccaucaccuacaacugcccccugcugagacagaacgagcccgaggacaucgacugcuggugcaacagcaccagcaccugggugaccuacggcaccugcaccgccaccggcgagcacagaagagagaagagaagcguggcccuggugccccacgugggcaugggccuggagaccagaaccgagaccuggaugagcagcgagggcgccuggaagcacgcccagagaaucgagaccuggauccugagacaccccggcuucgccaucauggccgccauccuggccuacaccaucggcaccacccacuuccagagagugcugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgccagcagaugccccacccagggcgagcccagccugaacgaggagcaggacaagagauucgugugcaagcacagcaugguggacagaggcuggggcaacggcugcggccuguucggcaagggcggcaucgugaccugcgccauguucaccugcaagaagaacauggagggcaagaucgugcagcccgagaaccuggaguacaccaucguggugaccccccacagcggcgaggagaacgccgugggcaacgacaccggcaagcacggcaaggagaucaaggugaccccccagagcagcaucaccgaggccgagcugaccggcuacggcaccgugaccauggagugcagccccagaaccggccuggacuucaacgagauggugcugcugcagauggagaacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucguggugagagugcaguacgagggcgacggcagccccugcaagauccccuucgagaucauggaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugagcugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcguggugaucaccuggaucggcaugaacagcagaagcaccagccugagcgugagccuggugcuggugggcguggugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagccacaaccagaccuuccugaucgacggccccgagaccaccgagugccccaacaccaacagagccuggaacagccuggagguggaggacuacggcuucggcguguucaccaccaacaucuggcugaagcugaaggagagacaggacguguucugcgacagcaagcugaugagcgccgccgugaaggacaacagagccgugcacgccgacaugggcuacuggaucgagagcgcccugaacgacaccuggaagaucgagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcaagcuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcauccugggcauggcccuguuccuggaggagaugcugagaaccagagugggcaccaagcacgccgugcugcugguggccgugagcuucaugacccugaucaccggcaacaugagcuucagagaccugggcagagugauggugauggugggcgccgccaugaccgacgacaucggcaugggcgugaccuaccuggcccugcuggccgccuucaaggugagacccaccuucgccgccggccugcugcugagaaagcugaccagcaaggagcugaugaugaccaccaucggcaucgugcugcugagccagagcaccauccccgagaccauccuggagcugaccgacgcccuggcccugggcaugauggugcugaagaucgugagaaacauggagaaguaccagcuggccgugaccaucauggccauccugugcgugcccaacgccgugauccugcagaacgccuggaaggugagcugcaccauccuggccguggugagcgugagcccccugcugcugaccagcagccagcagaaggccgacuggaucccccuggcccugaccaucaagggccugaaccccaccgccaucuuccugaccacccugagcagaaccaacaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugagaugggaggaccaggccgagaucagcggcagcagccccauccugagcaucaccaucagcgaggacggcagcaugagcaucaagaacgaggaggaggagcagacccugaccauccugaucagaaccggccugcuggugaucagcggccuguuccccgugagcauccccaucaccgccgccgccugguaccugugggaggugaagaagcagagagccggcgugcugugggacgugcccagccccccccccgugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacaagggcaagagaaucgagcccagcugggccgacgugagaaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucguggacaagaagggcaagguggugggccuguacggcaacggcguggugaccagaagcggcaccuacgugagcgccaucgcccagagcgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacaucaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggagcugaugagaagaggcgaccugcccguguggcuggccuacagaguggccgccgagggcaucaacuacgccgacagaagauggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagaaacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggacuucggcuucggcagcaucgccacccagcagcccgagagcaacauccuggacaucgaccugagacccgccagcgccuggacccuguacgccguggccaccaccuucaucacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggaccccauccccuacgaccccaaguucgagaagcagcugggccaggugaugcugcuggugcugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaccggcgagacccugggcgagaaguggaagaacagacugaacagccugggcaagagcgaguuccagaucuacaagagaagcggcauccaggagguggacagaacccuggccaaggagggcaucaagagaggcgagaccgaccaccacgccgugagcagaggcagcgccaagcugagaugguucguggagagaaaccuggugacccccgagggcaaggugauggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccguggaggccggcagaacccugagagugcugaaccugguggagaacuggcugaacaacaacacccaguucugcaucaaggugcugaaccccuacaugcccagcgugaucgagaagauggagacccugcagagaaaguacggcggcgcccuggugagaaacccccugagcagaaacagcacccacgagauguacugggugagcaacgccagcggcaacaucgugagcagcgugaacaugaucagcagaaugcugaucaacagauucaccaugagacacaagaaggccaccuacgagcccgacguggaccugggcagcggcaccagaaacaucggcaucgagagcgagacccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacgugauccccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcagauucugggagcugguggacaaggagagaaaccugcaccuggagggcaagugcgagaccugcguguacaacaugaugggcaagagagagaagaagaugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagaggugagcaagaaggagggcggcgccauguacgccgacgacaccgccggcugggacaccagaaucacccuggaggaccugaagaacgaggagauggugaccaaccacauggagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacaugggcgcccagcugaucagacagauggagggcgagggcguguucaagagcauccagcaccugaccaccaccgaggagguggccgugcaggacuggcuggccagagugggcagagagagacugagcagaauggccaucagcggcgacgacugcguggugaagccccuggacgacagauucgccagcgcccugaccgcccugaacgacaugggcaaggugagaaaggacauccagcagugggagcccagcagaggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugagagagaccgccugccugggcaagagcuacgcccagauguggagccugauguacuuccacagaagagaccugagacuggccgccaacgccaucugcagcgccgugcccagccacugggugcccaccagcagaaccaccuggagcauccacgccagacacgaguggaugaccaccgaggacaugcugaccguguggaacagaguguggauccaggagaaccccuggauggaggacaagacccccguggagagcugggaggagauccccuaccugggcaagagagaggaccaguggugcggcagccugaucggccugaccagcagagccaccugggccaagaacauccagaccgccaucaaccaggugagaagccugaucggcagcgaggaguacaccgacuacaugcccagcaugaagagauucagaagagaggaggaggaggccggcgugcugugguga

SEQ ID NO: 17598 - RNA, 9876 nt, Artificial Sequence
  derived and/or modified CDS sequence (opt4) from DENV-2__KJ918750__SS-prME
accgccggcaugaucaucaugcugauccccaccgugauggccuuccaccugaccaccagaaacggcgagccccacaugaucgugagcagacaggagaagggcaagagccugcuguucaagaccaaggacggcaccaacaugugcacccugauggccauggaccugggcgagcugugcgaggacaccaucaccuacaagugccccuuccugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgcccagagaaucgagaucuggauccugagacaccccggcuucaccaucauggccgccauccuggccuacaccaucggcaccacccacuuccagagagugcugaucuucauccugcugaccgccaucgcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgacagcagaugccccacccagggcgagcccacccugaacgaggagcaggacaagagauucgugugcaagcacagcaugguggacagaggcuggggcaacggcugcggccuguucggcaagggcggcaucgugaccugcgccauguucaccugcaagaagaucaugaagggcaagaucgugcagcccgagaaccuggaguacaccguggugaucaccccccacagcggcgaggagcacgccgugggcaacgacaccggcaagcacggcaaggaggugaagaucaccccccagagcagcaucaccgaggccgagcugaccggcuacggcaccgugaccauggagugcagccccagaaccggccuggacuucaacgagauggugcugcugcagauggaggacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucgugaucagagugcaguacgagggcgacggcagccccugcaagauccccuucgagaucauggaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagaugcuggagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaccggcgugaucaucaccuggaucggcaugaacagcagaagcaccagccugagcgugagccuggugcuggugggcaucgugacccuguaccugggcgugauggugcaggccgacagcggcugcguggugagcuggaagaacaaggagcugaagugcggcagcggcaucuucgugaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggugggcaagagaagccugagaccccagcccaccgagcugagauacagcuggaagaccuggggcaaggccaagaugcugagcaccgagcugcacaaccagaccuuccugaucgacggccccgagaccgccgagugccccaacaccaacagagccuggaacagccuggagguggaggacuacggcuucggcguguucaccaccaacaucuggcugagacugagagagaagcaggacguguucugcgacagcaagcugaugagcgccgccaucaaggacaacagagccgugcacgccgacaugggcuacuggaucgagagcgcccugaacgacaccuggaagaucgagaaggccagcuucaucgaggugaagagcugccacuggcccaagagccacacccuguggagcgacggcgugcuggagagcgagauggugauccccaagaacuucgccggccccgugagccagcacaacaacagacccggcuaccacacccagaccgccggccccuggcaccugggcaagcuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugagcagccuggugaccgccggccacggccagaucgacaacuucagccugggcauccugggcauggcccuguuccuggaggagaugcugagaaccagagugggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugaugaccaccaucggcaucgugcugcugagccagagcagcauccccgagaccauccuggagcugaccgacgcccuggcccugggcaugauggugcugaagauggugagaaacauggagaaguaccagcuggccgugaccaucauggccauccugugcgugcccaacgccgugauccugcagaacgccuggaaggugagcugcaccauccuggcccuggugagcgugagcccccuguuccugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugaagugggacgaccaggccgagaucagcggcagcagccccauccugagcaucaccaucagcgaggacggcagcaugagcaucaagaacgaggaggaggagcagacccugaccauccugaucagaaccggccugcuggugaucagcggccuguuccccgugagcauccccaucaccgccgccgccugguaccugugggaggugaagaagcagagagccggcgugcugugggacgugcccagccccccccccgugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacaagggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucguggacaagaagggcaagguggugggccuguacggcaacggcguggugaccagaagcggcgccuacgugagcgccaucgcccagaccgagaagagcaucgaggacaaccccgagaucgaggacgacaucuucagaaagagaagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccaucagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaagaccggcaacgacaucgccgccugccugagaaagaacggcaagagagugauccagcugagcagaaagaccuucgacagcgaguacgugaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaagauggugcuucgacggcaccagaaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagagacgcccuggacaaccuggccgugcugcacaccgccgaggccggcggcaaggccuacaaccacgcccugagcgagcugcccgagacccuggagacccugcugcugcugacccugcuggccaccgugaccggcggcaucuuccuguuccugaugagcggcagaggcaucggcaagaugacccugggcaugugcugcaucaucaccgccagcauccugcuguggugcgcccagauccagccccacuggaucgccgccagcaucauccuggaguucuuccugaucgugcugcugauccccgagcccgagaagcagagaaccccccaggacaaccagcugaccuacgugaucaucgccauccugaccgugguggccgccaccauggccaacgagaugggcuuccuggagaagaccaagaaggaccugggccugggcaacaucgugacccagcagcccgagagcaacauccuggacaucgaccugagacccgccagcgccuggacccuguacgccguggccaccaccuucaucacccccaugcugagacacagcaucgagaacagcagcgugaacaugagccugaccgccaucgccaaccaggccaccgugcugaugggccugggcaagggcuggccccugagcaagauggacaucggcgugccccugcuggccaucggcugcugcagccaggugaaccccaucacccugaccgccgcccuguuccugcugguggcccacuacgccaucaucggccccggccugcaggccaaggccaccagagaggcccagaagagagccgccgccggcaucaugaagaaccccaccguggacggcaucaccgugaucgaccuggaccccauccccuacgaccccaaguucgagaagcagcugggccaggugaugcugcuggugcugugcgugacccaggugcugaucaugagaaccaccugggcccugugcgaggcccugacccuggccaccggccccgugagcacccugugggagggcaaccccggcagauucuggaacaccaccaucgccgugagcauggccaacaucuucagaggcagcuaccuggccggcgccggccugcuguucugcaucaugaacaacaccaccagacugagaagaggcaccggccaccugagaaagacccugggcgacaagugcaagagcagacugaacacccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaaccuggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaucccccccgagaagugcgacacccugcugugcgacaucggcgagagcagccccaaccccaccguggaggccggcagaacccugagagugcugaaccugguggagaacuggcugaacaacaacacccaguucugcaucaaggugcugaaccccuacaugcccagcgugaucgagaagauggagacccugcagagaaaguacggcggcgcccuggugagaaacccccugagcagaaacagcacccacgagauguacugggugagcaacgccagcggcaacaucgugagcagcgugaacaugaucagcagaaugcugaucaacagauucaccaugagacacaagaaggccaccuacgagcccgacguggaccugggcagcggcaccagaaacaucggcaucgagagcgagacccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacguggugcccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccaagaaggugagaagcaacgccgcccugggcgccaucuucaccgacgagaacaaguggaagagcgccagagaggccguggaggacggcagauucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagaggugagcaagaaggagggcggcgccauguacgccgacgacaccgccggcugggacaccagaaucaccaucgaggaccugaagaacgaggagaugaucaccaaccacauggccggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcaucuucaagagcauccagcaccugaccgccaccgaggagaucgccgugcaggacuggcuggccagagugggcagagagagacugagcagaauggccaucagcggcgacgacugcguggugaagccccuggacgacagauucgccagagcccugaccgcccugaacgacaugggcaaggugagaaaggacauccagcagugggagcccagcagaggcuggaacgacuggacccaggugcccuucugcagccaccacuuccacgagcugaucaugaaggacggcagaacccugguggugcccugcagaaaccaggacgagcugaucggcagagccagaaucagccagggcgccggcuggagccugagagagaccgccugccugggcaagagcuacgcccagauguggagccugauguacuuccacagaagagaccugagacuggccgccaacgccaucugcagcgccgugcccagccacugggugcccaccagcagaaccaccuggagcauccacgccagccacgaguggaugaccaccgaggacaugcugaccguguggaacagaguguggauccaggagaaccccuggauggaggacaagacccccguggagagcugggaggagauccccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 17599 - RNA, 9876 nt, Artificial Sequence
  derived and/or modified CDS sequence (opt4) from DENV-2__KU517845__SS-prME
accgccggcaucaucaucaugaugauccccaccgugaucgccuuccaccugaccaccagaaacggcgagccccacaugaucgugagcagacaggagaagggcaagagccugcuguucaagaccgagaacggcgugaacaugugcacccugauggccauggaccugggcgagcugugcgaggacaccaucaccuacaacugcccccugcugagacagaacgagcccgaggacaucgacugcuggugcaacagcaccagcgccugggugaccuacggcaccugcaccgccaccggcgagcacagaagagagaagagaagcguggcccuggugccccacgugggcaugggccuggagaccagaaccgagaccuggaugagcagcgagggcgccuggaagcacgcccagagaaucgagaccugggugcugagacaccccggcuucaccaucauggccgccauccuggccuacaccaucggcaccaccuacuuccagagagugcugaucuucauccugcugaccgccgugacccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcaccccgccacccugagaaaguacugcaucgaggccaagcugaccaacaccaccaccgccagcagaugccccacccagggcgagcccagccugaacgaggagcaggacaagagauucgugugcaagcacagcaugguggacagaggcuggggcaacggcugcggccuguucggcaagggcggcaucgugaccugcgccauguucaccugcaagaagaacauggagggcaagaucgugcagcccgagaaccuggaguacaccaucgugaucaccccccacagcggcgaggagaacgccgugggcaacgacaccggcaagcacggcaaggagaucaaggugaccccccagagcagcaucaccgaggccgagcugaccggcuacggcaccgugaccauggagugcagccccagaaccggccuggacuucaacgagauggugcugcugcagauggagaacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucgugaucagagugcaguacgagggcgacggcagccccugcaagauccccuucgagaucauggaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugagcugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcguggugaucaccuggaucggcaugaacagcagaagcaccagccugagcgugagccuggugcuggugggcguggugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucauggccggcgacaucaagggcaucaugcaggccggcaagagaagccugagaccccagcccaccgagcugaaguacagcuggaaggccuggggcaaggccaagaugcugagcaccgagcugcacaaccacaccuuccugaucgacggccccgagaccgccgagugccccaacaccaacagagccuggaacagccuggagguggaggacuacggcuucggcguguucaccaccaacaucuggcugaagcugaaggagagacaggacgccuucugcgacagcaagcugaugagcgccgccaucaaggacaacagagccauccacgccgacaugggcuacuggaucgagagcgcccugaacgacaccuggaagaucgagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcagacuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugaugaccaccaucggcaucgugcugcugagccagagcaccauccccgagaccauccuggagcugaccgacgcccuggcccugggcaugauggugcugaagaucgugagaaacauggagaaguaccagcuggccgugaccaucauggccauccugugcgugcccaacgccgugauccugcagaacgccuggaaggugagcugcaccacccuggccguggugagcgugagcccccugcugcugaccagcagccagcagaaggccgacuggaucccccuggugcugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugagaugggaggagcaggccgagaucagcggcagcagccccauccugagcaucaccgugagcgaggacggcagcaugagcaucaagaacgaggaggaggagcagacccugaccauccugaucagaaccggccugcuggugaucagcggccuguuccccgugagcauccccaucaccgccgccgccugguaccugugggaggugaagaagcagagagccggcgugcugugggacgugcccagccccccccccgugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacaagggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucguggacaagaagggcaagguggugggccuguacggcaacggcguggugaccagaagcggcaccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccaucagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacaucaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagagugggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacagaguggccgccgagggcaucaacuacgccgacagaagauggugcuucgacggcgugaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagaaacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggacuucggccugggcagcaucgccaaccagcagcccgagagcaacauccuggacaucgaccugagacccgccagcgccuggacccuguacgccguggccaccaccuucaucacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggaccccauccccuacgaccccaaguucgagaagcagcugggccaggugaugcugcuggugcugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccgccaacaccagaagaggcaccggcaacaccggcgagacccugggcgagaaguggaagaacagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaaccuggugacccccgagggcaaggugguggaccugggcugcggcagaggcggcuggagcuacuacugcggcggccugaagaacgugaaggaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccguggaggccggcagaacccugagagugcugaaccugguggagaacuggcugaacaacaacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccagcggcaacaucgugagcagcgugaacaugaucagcagaaugcugaucaacagauucaccaugagacacaagaaggccaccuacgagcccgacguggaccugggcagcggcaccagaaacaucggcaucgagagcgagacccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacgugauccccauggugacccagauggccaugaccgacaccacccccuucggccagcagagaguguucaaggagaagguggacaccagaacccaggagcccaaggagggcaccaagaagaucaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcggcuucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccagccacaugaagggcgagcacagaaagcuggccgaggccaucuucaagcugaccuaccagaacaagguggugagagugcagagacccacccccagaggcaccgugauggacaucaucagcagaagagaccagagaggcagcggccagguggugaccuacggccugaacaccuucaccaacauggaggcccagcugaucagacagauggagggcgagggcguguucaagagcauccagcagcugaccgugaccgaggagaucgccgugaagaacuggcuggugagagugggcagagagagacugagcagaauggccaucagcggcgacgacugcguggugaagccccuggacgacagauucgccagcgcccugaccgcccugaacgacaugggcaaggugagaaaggacauccagcagugggagcccagcagaggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugagagagaccgccugccugggcaagagcuacgcccagauguggagccugauguacuuccacagaagagaccugagacuggccgccaacgccaucugcagcgccgugcccagccacugggugcccaccagcagaaccaccuggagcauccacgccacccacgaguggaugaccaccgaggacaugcugaccguguggaacagaguguggauccaggagaaccccuggauggaggacaagacccccguggagagcugggaggagauccccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 17600 - RNA, 9876 nt, Artificial Sequence
  derived and/or modified CDS sequence (opt4) from DENV-2__KU517847__SS-prME
accgccggcaucaucaucaugaugauccccaccgugauggccuuccaccugaccaccagaaacggcgagccccacaugaucgugagcagacaggagaagggcaagagccugcuguucaagaccgagaacggcgugaacaugugcacccugauggccauggaccugggcgagcugugcgaggacaccaucaccuacaacugcccccugcugagacagaacgagcccgaggacaucgacugcuggugcaacagcaccagcaccugggugaccuacggcaccugcaccgccaccggcgagcacagaagagagaagagaagcguggcccuggugccccacgugggcaugggccuggagaccagaaccgagaccuggaugagcagcgagggcgccuggaagcacgcccagagaaucgagaccugggugcugagacaccccggcuucaccaucauggccgccauccuggccuacaccaucggcaccaccuacuuccagagagugcugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcaccccgccacccugagaaaguacugcaucgaggccaagcugaccaacaccaccaccgccagcagaugccccacccagggcgagcccagccugaacgaggagcaggacaagagauucgugugcaagcacagcaugguggacagaggcuggggcaacggcugcggccuguucggcaagggcggcaucgugaccugcgccauguucaccugcaagaagaacauggagggcaagaucgugcagcccgagaaccuggaguacaccaucgugaucaccccccacagcggcgaggagaacgccgugggcaacgacaccggcaagcacggcaaggagaucaaggugaccccccagagcagcaucaccgaggccgagcugaccggcuacggcaccgugaccauggagugcagccccagaaccggccuggacuucaacgagauggugcugcugcagauggagaacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucgugaucagagugcaguacgagggcgacggcagccccugcaagauccccuucgagaucauggaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugagcugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcguggugaucaccuggaucggcaugaacagcagaagcaccagccugagcgugagccuggugcuggugggcguggugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugaccgagaacgaggugaagcugaccaucaugaccggcgacaucaagggcaucaugcaggccggcaagagaagccugagaccccagcccaccgagcugaaguacagcuggaaggccuggggcaaggccaaggugcugagcaccgagcugcacaaccacaccuuccugaucgacggccccgagaccgccgagugccccaacaccaacagagccuggaacagccuggagguggaggacuacggcuucggcguguucaccaccaacaucuggcugaagcugaaggagagacaggacgugagcugcgacagcaagcugaugagcgccgccaucaaggacaacagagccgugcacgccgacaugggcuacuggaucgagagcgcccugaacgacaccuggaagaucgagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcagacuggagauggacuucgacuucugcgagggcaccaccgugguggugaccgagaacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugaugaccaccaucggcaucgugcugcugagccagagcaccauccccgagaccauccuggagcugaccgacgcccuggcccugggcaugauggugcugaagaucgugagaaacauggagaaguaccagcuggccgugaccaucauggccauccugugcgugcccaacgccgugauccugcagaacgccuggaaggugagcugcaccgcccuggccguggugagcgugagcccccugcugcugaccagcagccagcagaagaccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagcuuccugaagaacgacauccccaugaccggcccccugguggccggcggccugcugaccgugugcuacgugcugaccggcagaagcgccgaccuggagcuggagagagccgccgacaucagaugggaggagcaggccgagaucagcggcagcagccccauccugagcaucaccaucagcgaggacggcagcaugagcaucaagaacgaggaggaggagcagacccugaccauccugaucagaaccggccugcuggugaucagcggccuguuccccgccagcauccccaucaccgccgccgccugguaccugugggaggugaagaagcagagagccggcgugcugugggacgugcccagccccccccccgugggcagagccgagcuggaggacggcgccuacagaaucaagcagaagggcauccugggcuacagccagaucggcgccggcguguacaaggagggcaccuuccacaccauguggcacgugaccagaggcgccgugcugaugcacaagggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucguggacaagaagggcaagguggugggccuguacggcaacggcguggugaccagaagcggcaccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccaucagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacaucaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagagugggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacagaguggccgccgagggcaucaacuacgccgacagaagauggugcuucgacggcgugaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagaaacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucgugaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggacuucggccugggcagcaucaccacccagcagcccgagagcaacauccuggacaucgaccugagacccgccagcgccuggacccuguacgccguggccaccaccuucaucacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggaccccauccccuacgaccccaaguucgagaagcagcugggccaggugaugcugcuggugcugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccgccaacaccagaagaggcaccggcaacaccggcgagacccugggcgagaaguggaagaacagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaaccuggugacccccgagggcaaggugguggaccugggcugcggcagaggcggcuggagcuacuacugcggcggccugaagaacgugaaggaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccguggaggccggcagaacccugagagugcugaaccugguggagaacuggcugaacaacaacacccaguucugcaucaaggugcugaaccccuacaugcccagcgugaucgagaagauggaggcccugcagagaagauacggcggcgcccuggugagaaacccccccagcagaaacagcacccacgagauguacugggugagcaacgccagcggcaacaucgugagcagcgugaacaugaucagcagaaugcugaucaacagauucaccaugagacacaagaaggccaccuacgagcccgacguggaccugggcagcggcaccagaaacaucggcaucgagagcgaggugcccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacgugauccccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcggcuucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacauggagggcgagcacaagaagcuggccgaggccaucuucagacugaccuaccagaacaagguggugagagugcagagacccacccccagaggcaccgugauggacaucaucagcagaagagaccagagaggcagcggccagguggugaccuacggccugaacaccuucaccaacauggaggcccagcugaucagacagauggagggcgagggcguguucaagagcauccagcaccugaccgccaccgaggagaucgccgugaagaacuggcuggugagagugggcagagagagacugagcagaauggccaucagcggcgacgacugcguggugaagcccuucgacgacagauucgccaacgcccugaccgcccugaacgacaugggcaaggugagaaaggacauccagcagugggagcccagcagaggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugagagagaccgccugccugggcaagagcuacgcccagauguggagccugauguacuuccacagaagagaccugagacuggccgccaacgccaucugcagcgccgugcccagccacugggugcccaccagcagaaccaccuggagcauccacgccacccacgaguggaugaccaccgaggacaugcugaccguguggaacagaguguggauccaggagaaccccuggauggaggacaagacccccguggagagcugggaggagauccccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 17601 - RNA, 9876 nt, Artificial Sequence
  derived and/or modified CDS sequence (opt4) from DENV-2__JQ955623__SS-prME
accgccggcaugaucaucaugcugauccccaccgccauggccuuccaccugaccaccagaaacggcgagccccacaugaucgugagcagacaggagaagggcaagagccugcuguucaagaccgaggacggcgugaacaugugcacccugauggccauggaccugggcgagcugugcgaggacaccaucaccuacaacugcccccugcugagacagaacgagcccgaggacaucgacugcuggugcaacagcaccagcaccugggugaccuacggcaccugcaccgccaccggcgagcacagaagagagaagagaagcguggcccuggugccccacgugggcaugggccuggagaccagaaccgagaccuggaugagcagcgagggcgccuggaagcacgcccagagaaucgagaccuggauccugagacaccccggcuucaccaucauggccgccauccuggccuacaccaucggcaccacccacuuccagagagugcugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgccagcagaugccccacccagggcgagcccagccugaacgaggagcaggacaagagauucgugugcaagcacagcaugguggacagaggcuggggcaacggcugcggccuguucggcaagggcggcaucgugaccugcgccauguucaccugcaagaagaacauggagggcaagaucgugcagcccgagaaccuggaguacaccaucguggugaccccccacagcggcgaggagaacgccgugggcaacgacaccggcaagcacggcaaggagaucaaggugaccccccagagcagcaucaccgaggccgagcugaccggcuacggcaccgugaccauggagugcagccccagaaccggccuggacuucaacgagauggugcugcugcagauggagaacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucgugaucagagugcaguacgagggcgacggcagccccugcaagauccccuucgagaucauggaccuggagaagagacacgugcugggcagacugaucaccgugaaccccaucgugaccgagaaggacagccccgugaacaucgaggccgagccccccuucggcgacagcuacaucaucgugggcguggagcccggccagcugaagcugagcugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcguggugaucaccuggaucggcaugaacagcagaagcaccagccugagcgugagccuggugcuggugggcaucgugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagccccacaaccagaccuuccugaucgacggccccgagaccgccgagugccccaacaccaacagagccuggaacagccuggagguggaggacuacggcuucggcguguucaccaccaacaucuggcugaagcugaaggagagacaggacguguucugcgacagcaagcugaugagcgccgccaucaaggacaacagagccgugcacgccgacaugggcuacuggaucgagagcgcccugaacgacaccuggaagaucgagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcaagcuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccgugcugcugguggccgugagcuucaugacccugaucaccggcaacaugagcuucagagaccugggcagagugauggugauggugggcgccgccaugaccgacgacaucggcaugggcgugaccuaccuggcccugcuggccgccuucaaggugagacccaccuucgccgccggccugcugcugagaaagcugaccagcaaggagcugaugaugaccaccaucggcaucgugcugcugagccagagcaccauccccgagaccauccuggagcugaccgacgcccuggcccugggcaugaugauccugaagaucgugagaaacauggagaaguaccagcuggccgugaccaucauggccauccugugcgugcccaacgccgugauccugcagaacgccuggaaggugagcugcaccauccuggccguggugagcgugagcccccugcugcugaccagcagccagcagaaggccgacuggaucccccuggcccugaccaucaagggccugaaccccaccgccaucuuccugaccacccugagcagaaccaacaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugagaugggaggaccaggccgagaucagcggcagcagccccauccugagcaucaccaucagcgaggacggcagcaugagcaucaagaacgaggaggaggagcagacccugaccauccugaucagaaccggccugcuggugaucagcggccuguuccccgugagcauccccaucaccgccgccgccugguaccugugggaggugaagaagcagagagccggcgugcugugggacgugcccagccccccccccgugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacaagggcaagagaaucgagcccagcugggccgacgugagaaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucguggacaagaagggcaagguggugggccuguacggcaacggcguggugaccagaagcggcaccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacaucaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacagaguggccgccgagggcaucaacuacgccgacagaagauggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagaaacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggacuucggccugggcagcaucgccacccagcagcuggagagcaacauccuggacaucgaccugagacccgccagcgccuggacccuguacgccguggccaccaccuucaucacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggaccccauccccuacgaccccaaguucgagaagcagcugggccaggugaugcugcuggugcugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaccggcgagacccugggcgagaaguggaagaacagacugaacagccugggcaagagcgaguuccagaucuacaagagaagcggcauccaggagguggacagaacccuggccaaggagggcaucaagagaggcgagaccgaccaccacgccgugagcagaggcagcgccaagcugagaugguucguggagagaaaccuggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccguggaggccggcagaacccugagagugcugaaccugguggagaacuggcugaacaacgacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccagcggcaacaucgugagcagcgugaacaugaucagcagaaugcugaucaacagauucaccaugagacacaagaaggccaccuacgagcccgacguggaccugggcagcggcaccagaaacaucggcaucgagagcgagacccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacgugauccccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcagauucugggagcuggugaacaaggagagaaaccugcaccuggagggcaagugcgagaccugcguguacaacaugaugggcaagagagagaagaagaucggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagaggugagcaagaaggagggcggcgccauguacgccgacgacaccgccggcugggacaccagaaucacccuggaggaccugaagaacgaggagauggugaccaaccacauggagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacaugggcgcccagcugaucagacagauggagggcgagggcguguucaagggcauccagcaccugaccgccaccgaggagaccgccgugcacgacuggcuggccagagugggcagagagagacugagcagaauggccaucagcggcgacgacugcguggugaagccccuggacgacagauucgccagcgcccugaccgcccugaacgacaugggcaaggugagaaaggacauccagcagugggagcccagcagaggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugagagagaccgccugccugggcaagagcuacgcccagauguggagccugauguacuuccacagaagagaccugagacuggccgccaacgccaucugcagcgccgugcccagccacugggugcccaccagcagaaccaccuggagcauccacgccagacacgaguggaugaccaccgaggacaugcugaccguguggaacagaguguggauccaggagaaccccuggauggaggacaagacccccguggagagcugggaggagauccccuaccugggcaagagagaggaccaguggugcggcagccugaucggccugaccagcagagccaccugggccaagaacauccagaccgccaucaaccaggugagaagccugaucggcagcgaggaguacaccgacuacaugcccagcaugaagagauucagaagagaggaggaggaggccggcgugcugugguga

SEQ ID NO: 17602 - RNA, 9876 nt, Artificial Sequence
  derived and/or modified CDS sequence (opt4) from DENV-2__KR779782__SS-prME
accgccggcaucaucaucaugaugauccccaccgugauggccuuccaccugaccaccagaaacggcgagccccacaugaucgugagcagacaggagaagggcaagagccugcuguucaagaccgagaacggcgugaacaugugcacccugauggccauggaccugggcgagcugugcgaggacaccaucaccuacaacugcccccugcugagacagaacgagcccgaggacaucgacugcuggugcaacagcaccagcaccugggugaccuacggcaccugcaccgccaccggcgagcacagaagagagaagagaagcguggcccuggugccccacgugggcaugggccuggagaccagaaccgagaccuggaugagcagcgagggcgccuggaagcacgcccagagaaucgagaccuggauccugagacaccccggcuucaccaucauggccgccauccuggccuacaccaucggcaccaccuacuuccagagagugcugaucuucauccugcugaccgccgugacccccagcauggccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcaccccgccacccugagaaaguacugcguggaggccaagcugaccaacaccaccaccgccagcagaugccccacccagggcgagcccagccugaacgaggagcaggacaagagauucgugugcaagcacagcaugguggacagaggcuggggcaacggcugcggccuguucggcaagggcggcaucgugaccugcgccauguucaccugcaagaagaacauggagggcaagguggugcagcccgagaaccuggaguacaccaucgugaucaccccccacagcggcgaggagaacgccgugggcaacgacaccggcaagcacggcaaggagaucaaggugaccccccagagcagcaucaccgaggccgagcugaccggcuacggcaccgugaccauggagugcagccccagaaccggccuggacuucaacgagauggugcugcugcagauggagaacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucgugaucagagugcaguacgagggcgacggcagccccugcaagauccccuucgagaucauggaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugagcugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcguggugaucaccuggaucggcaugaacagcagaagcaccagccugagcgugagccuggugcuggugggcguggugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgagcagggcaucugcggcaucagaagcgugaccagacuggagaaccugauguggaagcagaucacccccgagcugaaccacauccugaccgagaacgaggugaagcugaccaucaugaccggcgacaucaagggcaucaugcaggccggcaagagaagccugagaccccagcccaccgagcugaaguacagcuggaaggccuggggcaaggccaagaugcugagcaccgagcugcacaaccacaccuuccugaucgacggccccgagaccgccgagugccccaacaccaacagagccuggaacagccuggagguggaggacuacggcuucggcguguucaccaccaacaucuggcugaagcugaaggagagacaggacguguucugcgacagcaagcugaugagcgccgccaucaaggacaacagagccgugcacgccgacaugggcuacuggaucgagagcgcccugaacgacaccuggaagaucgagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcagacuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugaugaccaccaucggcaucgugcugcugagccagagcaccauccccgagagcauccuggagcugaccgacgcccuggcccugggcaugauggugcugaagaucgugagaaacauggagaaguaccagcuggccgugaccaucauggccauccugugcgugcccaacgccgugauccugcagaacgccuggaaggugagcugcaccacccuggccguggugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugagaugggaggagcaggccgagaucagcggcagcagccccauccugagcaucaccaucagcgaggacggcagcaugagcaucaagaacgaggaggaggagcagacccugaccauccugaucagaaccggccugcuggugaucagcggccuguuccccgugagcauccccaucaccgccgccgccugguaccugugggaggugaagaagcagagagccggcgugcugugggacgugcccagccccccccccgugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacaagggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucguggacaagaagggcaagguggugggccuguacggcaacggcguggugaccagaagcggcaccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccaucagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacaucaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagagugggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacagaguggccgccgagggcaucaacuacgccgacagaagauggugcuucgacggcgugaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccaagaacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggacuucggccugggcagcaucaccacccagcagcccgagagcaacauccuggacaucgaccugagacccgccagcgccuggacccuguacgccguggccaccaccuucaucacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaugaccgugaucgaccuggaccccauccccuacgaccccaaguucgagaagcagcugggccaggugaugcugcuggugcugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccgccaacaccagaagaggcaccggcaacaccggcgagacccugggcgagaaguggaagaacagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaaccuggugacccccgagggcaaggugguggaccugggcugcggcagaggcggcuggagcuacuacugcggcggccugaagaacgugaaggaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccguggaggccggcagaacccugagagugcugaaccugguggagaacuggcugaacaacaacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccagcggcaacaucgugagcagcgugaacaugaucagcagaaugcugaucaacagauucaccaugagacacaagaaggccaccuacgagcccgacguggaccugggcagcggcaccagaaacaucggcaucgagagcgagacccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacgugauccccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcggcuucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacauggagggcgagcacaagaagcuggccgaggccaucuucaagcugaccuaccagaacaagguggugagagugcagagacccacccccagaggcaccgugauggacaucaucagcagaagagaccagagaggcagcggccagguggugaccuacggccugaacaccuucaccaacauggaggcccagcugaucagacagauggagggcgagggcguguucaagagcauccagcagcugaccgugaaggaggagaucgccgugaagaacuggcugaucagagugggcagagagagacugagcagaauggccaucagcggcgacgacugcguggugaagccccuggacgacagauucgccagcgcccugaccgcccugaacgacaugggcaaggugagaaaggacauccagcagugggagcccagcagaggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugagagagaccgccugccugggcaagagcuacgcccagauguggagccugauguacuuccacagaagagaccugagacuggccgccaacgccaucugcagcgccgugcccagccacugggugcccaccagcagaaccaccuggagcauccacgccacccacgaguggaugaccaccgaggacaugcugaccguguggaacagaguguggauccaggagaaccccuggauggaggacaagacccccguggagagcugggaggagauccccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 17603 - RNA, 9876 nt, Artificial Sequence
  derived and/or modified CDS sequence (opt4) from DENV-2__KM279608__SS-prME
accgccggcaucaucaucaugaugauccccaccgugauggccuuccaccugaccaccagaaacggcgagccccacaugaucgugagcagacaggagaagggcaagagccugcuguucaagaccgagaacggcgugaacaugugcacccugauggccauggaccugggcgagcugugcgaggacaccaucaccuacaacugcccccugcugagacagaacgagcccgaggacaucgacugcuggugcaacagcaccagcaccugggugaccuacggcaccugcaccgugaccggcgagcacagaagagagaagagaagcguggcccuggugccccacgugggcaugggccuggagaccagaaccgagaccuggaugagcagcgagggcgccuggaagcacgcccagagaaucgagaccuggauccugagacaccccggcuucaccaucauggccgccauccuggccuacaccaucggcaccaccuaccugcagagagugcugaucuucauccugcugaccgccgugacccccagcauggccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcaccccgccacccugagaaaguacugcguggaggccaagcugaccaacaccaccaccgccagcagaugccccacccagggcgagcccagccugaacgaggagcaggacaagagauucgugugcaagcacagcaugguggacagaggcuggggcaacggcugcggccuguucggcaagggcggcaucgugaccugcgccauguucaccugcaagaagaacauggagggcaagguggugcagcccgagaaccuggaguacaccaucgugaucaccccccacagcggcgaggagaacgccgugggcaacgacaccggcaagcacggcaaggagaucaaggugaccccccagagcagcaucaccgaggccgagcugaccggcuacggcaccgugaccauggagugcagccccagaaccggccuggacuucaacgagauggugcugcugcagauggagaacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucgugaucagagugcaguacgagggcgacggcagccccugcaagauccccuucgagaucauggaccuggagaagagacacgugcugggcagacugaucaccgugaaccccaucgugaccgagaaggacaaccccgugaacaucgaggccgagccccccuucggcgacagcuacaucaucaucggcguggagcccggccagcugaagcugagcugguacaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcguggugaucaccuggaucggcaugaacagcagaagcaccagccugagcgugagccuggugcuggugggcguggugacccuguaccugggcgugauggugcaggccgacagcggcugcguggugagcuggagaaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugaccgagaacgaggugaagcugaccaucaugaccggcgacaucaagggcaucaugcaggccggcaagagaagccugagaccccagcccaccgagcugaaguacagcuggaaggccuggggcaaggccaagaugcugagcaccgagcugcacaaccacaccuuccugaucgacggccccgagaccgccgagugccccaacaccaacagagccuggaacagccuggagguggaggacuacggcuucggcguguucaccaccaacaucuggcugaagcugaaggagagacaggacguguucugcgacagcaagcugaugagcgccgccaucaaggacaacagagccgugcacgccgacaugggcuacuggaucgagagcgcccugaacgacaccuggaagaucgagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcagacuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugaugaccaccaucggcaucgugcugcugagccagagcaccauccccgagagcauccuggagcugaccgacgcccuggcccugggcaugauggugcugaagaucgugagaaacauggagaaguaccagcuggccgugaccaucauggccauccugugcgugcccaacgccgugauccuggagaacgccuggaaggugagcugcaccacccuggccguggugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugagaugggaggagcaggccgagaucagcggcagcagccccauccugagcaucaccaucagcgaggacggcagcaugagcaucaagaacgaggaggaggagcagacccugaccauccugaucagaaccggccugcuggugaucagcggccuguuccccgugagcauccccaucaccgccgccgccugguaccugugggaggugaagaagcagagagccggcgugcugugggacgugcccagccccccccccgugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacaagggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucguggacaagaagggcaagguggugggccuguacggcaacggcguggugaccagaagcggcaccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccaucagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacaucaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagagugggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaagauggugcuucgacggcgugaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccaagaacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggacuucggccugggcagcaucaccacccagcagcccgagagcaacauccuggacaucgaccugagacccgccagcgccuggacccuguacgccguggccaccaccuucaucacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggaccccauccccuacgaccccaaguucgagaagcagcugggccaggugaugcugcuggugcugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccgccaacaccagaagaggcaccggcaacaccggcgagacccugggcgagaaguggaagaacagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaaccuggugacccccgagggcaaggugguggaccugggcugcggcagaggcggcuggagcuacuacugcggcggccugaagaacgugaaggaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccguggaggccggcagaacccugagagugcugaaccugguggagaacuggcugaacaacaacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccagcggcaacaucgugagcagcgugaacaugaucagcagaaugcugaucaacagauucaccaugagacacaagaaggccaccuacgagcccgacguggaccugggcagcggcaccagaaacaucggcaucgagagcgagacccccaaccuggacaucaucggcaagagaaucaagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacgugauccccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcggcuucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacauggagggcgagcacaagaagcuggccgaggccaucuucaagcugaccuaccagaacaagguggugagagugcagagacccacccccagaggcaccgugauggacaucaucagcagaagagaccagagaggcagcggccagguggugaccuacggccugaacaccuucaccaacauggaggcccagcugaucagacagauggagggcgagggcguguucaagagcauccagcagcugaccgugaaggaggagaucgccgugaagaacuggcugaucagagugggcagagagagacugagcagaauggccaucagcggcgacgacugcguggugaagccccuggacgacagauucgccagcgcccugaccgcccugaacgacaugggcaaggugagaaaggacauccagcagugggagcccagcagaggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugagagagaccgccugccugggcaagagcuacgcccagauguggagccugauguacuuccacagaagagaccugagacuggccgccaacgccaucugcagcgccgugcccagccacugggugcccaccagcagaaccaccuggagcauccacgccacccacgaguggaugaccaccgaggacaugcugaccguguggaacagaguguggauccaggagaaccccuggauggaggacaagacccccguggagagcugggaggagauccccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 17604 - RNA, 9876 nt, Artificial Sequence
  derived and/or modified CDS sequence (opt4) from DENV-2__KM279605__SS-prME
accgccggcaucaucaucaugaugauccccaccgugauggccuuccaccugaccaccagaaacggcgagccccacaugaucgugagcagacaggagaagggcaagagccugcuguucaagaccgagaacggcgugaacaugugcacccugauggccauggaccugggcgagcugugcgaggacaccaucaccuacaacugcccccugcugagacagaacgagcccgaggacaucgacugcuggugcaacagcaccagcaccugggugaccuacggcaccugcaccgccaccggcgagcacagaagagagaagagaagcguggcccuggugccccacgugggcaugggccuggagaccagaaccgagaccuggaugagcagcgagggcgccuggaagcacgcccagagaaucgagaccuggauccugagacaccccggcuucaccaucauggccgccauccuggccuacaccaucggcaccaccuacuuccagagagugcugaucuucauccugcugaccgccgugacccccagcauggccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcaccccgccacccugagaaaguacugcguggaggccaagcugaccaacaccaccaccgccagcagaugccccacccagggcgagcccagccugaacgaggagcaggacaagagauucgugugcaagcacagcaugguggacagaggcuggggcaacggcugcggccuguucggcaagggcggcaucgugaccugcgccauguucaccugcaagaagaacauggagggcaagguggugcagcccgagaaccuggaguacaccaucgugaucaccccccacagcggcgaggagaacgccgugggcaacgacaccggcaagcacggcaaggagaucaaggugaccccccagagcagcaucaccgaggccgagcugaccggcuacggcaccgugaccauggagugcagccccagaaccggccuggacuucaacgagauggugcugcugcagauggagaacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucgugaucagagugcaguacgagggcgacggcagccccugcaagauccccuucgagaucauggaccuggagaagagacacgugcugggcagacugaucaccgugaaccccaucgugaccgagaaggacaaccccgugaacaucgaggccgagccccccuucggcgacagcuacaucaucaucggcguggagcccggccagcugaagcugagcugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcguggugaucaccuggaucggcaugaacagcagaagcaccagccugagcgugagccuggugcuggugggcguggugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugaccgagaacgaggugaagcugaccaucaugaccggcgacaucaagggcaucaugcaggccggcaagagaagccugagaccccagcccaccgagcugaaguacagcuggaaggccuggggcaaggccaagaugcugagcaccgagcugcacaaccacaccuuccugaucgacggccccgagaccgccgagugccccaacaccaacagagccuggaacagccuggagguggaggacuacggcuucggcguguucaccaccaacaucuggcugaagcugaaggagagacaggacguguucugcgacagcaagcugaugagcgccgccaucaaggacaacagagccgugcacgccgacaugggcuacuggaucgagagcgcccugaacgacaccuggaagaucgagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcagacuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugaugaccaccaucggcaucgugcugcugagccagagcaccauccccgagagcauccuggagcugaccgacgcccuggcccugggcaugauggugcugaagaucgugagaaacauggagaaguaccagcuggccgugaccaucauggccauccugugcgugcccaacgccgugauccuggagaacgccuggaaggugagcugcaccacccuggccguggugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugagaugggaggagcaggccgagaucagcggcagcagccccauccugagcaucaccaucagcgaggacggcagcaugagcaucaagaacgaggaggaggagcagacccugaccauccugaucagaaccggccugcuggugaucagcggccuguuccccgugagcauccccaucaccgccgccgccugguaccugugggaggugaagaagcagagagccggcgugcugugggacgugcccagccccccccccgugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacaagggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucguggacaagaagggcaagguggugggccuguacggcaacggcguggugaccagaagcggcaccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccaucagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacaucaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagagugggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaagauggugcuucgacggcgugaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccaagaacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggacuucggccugggcagcaucaccacccagcagcccgagagcaacauccuggacaucgaccugagacccgccagcgccuggacccuguacgccguggccaccaccuucaucacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggaccccauccccuacgaccccaaguucgagaagcagcugggccaggugaugcugcuggugcugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccgccaacaccagaagaggcaccggcaacaccggcgagacccugggcgagaaguggaagaacagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaaccuggugacccccgagggcaaggugguggaccugggcugcggcagaggcggcuggagcuacuacugcggcggccugaagaacgugaaggaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccguggaggccggcagaacccugagagugcugaaccugguggagaacuggcugaacaacaacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccagcggcaacaucgugagcagcgugaacaugaucagcagaaugcugaucaacagauucaccaugagacacaagaaggccaccuacgagcccgacguggaccugggcagcggcaccagaaacaucggcaucgagagcgagacccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacgugauccccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcggcuucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacauggagggcgagcacaagaagcuggccgaggccaucuucaagcugaccuaccagaacaagguggugagagugcagagacccacccccagaggcaccgugauggacaucaucagcagaagagaccagagaggcagcggccagguggugaccuacggccugaacaccuucaccaacauggaggcccagcugaucagacagauggagggcgagggcguguucaagagcauccagcagcugaccgugaaggaggagaucgccgugaagaacuggcugaucagagugggcagagagagacugagcagaauggccaucagcggcgacgacugcguggugaagccccuggacgacagauucgccagcgcccugaccgcccugaacgacaugggcaaggugagaaaggacauccagcagugggagcccagcagaggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugagagagaccgccugccugggcaagagcuacgcccagauguggagccugauguacuuccacagaagagaccugagacuggccgccaacgccaucugcagcgccgugcccagccacugggugcccaccagcagaaccaccuggagcauccacgccacccacgaguggaugaccaccgaggacaugcugaccguguggaacagaguguggauccaggagaaccccuggauggaggacaagacccccguggagagcugggaggagauccccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 17605 - RNA, 9876 nt, Artificial Sequence
  derived and/or modified CDS sequence (opt4) from DENV-2__KM279609__SS-prME
accgccggcaucaucaucaugaugauccccaccgugauggccuuccaccugaccaccagaaacggcgagccccacaugaucgugagcagacaggagaagggcaagagccugcuguucaagaccgagaacggcgugaacaugugcacccugauggccauggaccugggcgagcugugcgaggacaccaucaccuacaacugcccccugcugagacagaacgagcccgaggacaucgacugcuggugcaacagcaccagcaccugggugaccuacggcaccugcaccgccaccggcgagcacagaagagagaagagaagcguggcccuggugccccacgugggcaugggccuggagaccagaaccgagaccuggaugagcagcgagggcgccuggaagcacgcccagagaaucgagaccuggauccugagacaccccggcuucaccaucauggccgccauccuggccuacaccaucggcaccaccuacuuccagagagugcugaucuucauccugcugaccgccgugacccccagcauggccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcaccuggccacccugagaaaguacugcguggaggccaagcugaccaacaccaccaccgccagcagaugccccacccagggcgagcccagccugaacgaggagcaggacaagagauucgugugcaagcacagcaugguggacagaggcuggggcaacggcugcggccuguucggcaagggcggcaucgugaccugcgccauguucaccugcaagaagaacauggagggcaagguggugcagcccgagaaccuggaguacaccaucgugaucaccccccacagcggcgaggagaacgccgugggcaacgacaccggcaagcacggcaaggagaucaaggugaccccccagagcagcaucaccgaggccgagcugaccggcuacggcaccgugaccauggagugcagccccagaaccggccuggacuucaacgagauggugcugcugcagauggagaacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucgugaucagagugcaguacgagggcgacggcagccccugcaagauccccuucgagaucauggaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugagcugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcguggugaucaccuggaucggcaugaacagcagaagcaccagccugagcgugagccuggugcuggugggcguggugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugaccgagaacgaggugaagcugaccaucaugaccggcgacaucaagggcaucaugcaggccggcaagagaagccugagaccccagcccaccgagcugaaguacagcuggaaggccuggggcaaggccaagaugcugagcaccgagcugcacaaccacaccuuccugaucgacggccccgagaccgccgagugccccaacaccaacagagccuggaacagccuggagguggaggacuacggcuucggcguguucaccaccaacaucuggcugaagcugaaggagagacaggacguguucugcgacagcaagcugaugagcgccgccaucaaggacaacagagccgugcacgccgacaugggcuacuggaucgagagcgcccugaacgacaccuggaagaucgagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcagacuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugaugaccaccaucggcaucgugcugcugagccagagcaccauccccgagagcauccuggagcugaccgacgcccuggcccugggcaugauggugcugaagaucgugagaaacauggagaaguaccagcuggccgugaccaucauggccauccugugcgugcccaacgccgugauccugcagaacgccuggaaggugagcugcaccacccuggccguggugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugagaugggaggagcaggccgagaucagcggcagcagccccauccugagcaucaccaucagcgaggacggcagcaugagcaucaagaacgaggaggaggagcagacccugaccauccugaucagaaccggccugcuggugaucagcggccuguuccccgugagcauccccaucaccgccgccgccugguaccugugggaggugaagaagcagagagccggcgugcugugggacgugcccagccccccccccgugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacaagggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucguggacaagaagggcaagguggugggccuguacggcaacggcguggugaccagaagcggcaccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccaucagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacaucaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagagugggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacagaguggccgccgagggcaucaacuacgccgacagaagauggugcuucgacggcgugaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccaagaacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggacuucggccugggcagcaucaccacccagcagcccgagagcaacauccuggacaucgaccugagacccgccagcgccuggacccuguacgccguggccaccaccuucaucacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaugaccgugaucgaccuggaccccauccccuacgaccccaaguucgagaagcagcugggccaggugaugcugcuggugcugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccgccaacaccagaagaggcaccggcaacaccggcgagacccugggcgagaaguggaagaacagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaaccuggugacccccgagggcaaggugguggaccugggcugcggcagaggcggcuggagcuacuacugcggcggccugaagaacgugaaggaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccguggaggccggcagaacccugagagugcugaaccugguggagaacuggcugaacaacaacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccagcggcaacaucgugagcagcgugaacaugaucagcagaaugcugaucaacagauucaccaugagacacaagaaggccaccuacgagcccgacguggaccugggcagcggcaccagaaacaucggcaucgagagcgagacccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacgugauccccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcggcuucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacauggagggcgagcacaagaagcuggccgaggccaucuucaagcugaccuaccagaacaagguggugagagugcagagacccacccccagaggcaccgugauggacaucaucagcagaagagaccagagaggcagcggccagguggugaccuacggccugaacaccuucaccaacauggaggcccagcugaucagacagauggagggcgagggcguguucaagagcauccagcagcugaccgugaaggaggagaucgccgugaagaacuggcugaucagagugggcagagagagacugagcagaauggccaucagcggcgacgacugcguggugaagccccuggacgacagauucgccagcgcccugaccgcccugaacgacaugggcaaggugagaaaggacauccagcagugggagcccagcagaggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugagagagaccgccugccugggcaagagcuacgcccagauguggagccugauguacuuccacagaagagaccugagacuggccgccaacgccaucugcagcgccgugcccagccacuggauccccaccagcagaaccaccuggagcauccacgccacccacgaguggaugaccaccgaggacaugcugaccguguggaacagaguguggauccaggagaaccccuggauggaggacaagacccccguggagagcugggaggagauccccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 17606 - RNA, 9876 nt, Artificial Sequence
  derived and/or modified CDS sequence (opt4) from DENV-2__KM279607__SS-prME
accgccggcaucaucaucaugaugauccccaccgugauggccuuccaccugaccaccagaaacggcgagccccacaugaucgugagcagacaggagaagggcaagagccugcuguucaagaccgagaacggcgugaacaugugcacccugauggccauggaccugggcgagcugugcgaggacaccaucaccuacaacugcccccugcugagacagaacgagcccgaggacaucgacugcuggugcaacagcaccagcaccugggugaccuacggcaccugcaccgccaccggcgagcacagaagagagaagagaagcguggcccuggugccccacgugggcaugggccuggagaccagaaccgagaccuggaugagcagcgagggcgccuggaagcacgcccagagaaucgagaccuggauccugagacaccccggcuucaccaucauggccgccauccuggccuacaccaucggcaccaccuaccugcagagagugcugaucuucauccugcugaccgccgugacccccagcauggccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcaccccgccacccugagaaaguacugcguggaggccaagcugaccaacaccaccaccgccagcagaugccccacccagggcgagcccagccugaacgaggagcaggacaagagauucgugugcaagcacagcaugguggacagaggcuggggcaacggcugcggccuguucggcaagggcggcaucgugaccugcgccauguucaccugcaagaagaacauggagggcaagguggugcagcccgagaaccuggaguacaccaucgugaucaccccccacagcggcgaggagaacgccgugggcaacgacaccggcaagcacggcaaggagaucaaggugaccccccagagcagcaucaccgaggccgagcugaccggcuacggcaccgugaccauggagugcagccccagaaccggccuggacuucaacgagauggugcugcugcagauggagaacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucgugaucagagugcaguacgagggcgacggcagccccugcaagauccccuucgagaucauggaccuggagaagagacacgugcugggcagacugaucaccgugaaccccaucgugaccgagaaggacaaccccgugaacaucgaggccgagccccccuucggcgacagcuacaucaucaucggcguggagcccggccagcugaagcugagcugguacaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcguggugaucaccuggaucggcaugaacagcagaagcaccagccugagcgugagccuggugcuggugggcguggugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugaccgagaacgaggugaagcugaccaucaugaccggcgacaucaagggcaucaugcaggccggcaagagaagccugagaccccagcccaccgagcugaaguacagcuggaaggccuggggcaaggccaagaugcugagcaccgagcugcacaaccacaccuuccugaucgacggccccgagaccgccgagugccccaacaccaacagagccuggaacagccuggagguggaggacuacggcuucggcguguucaccaccaacaucuggcugaagcugaaggagagacaggacguguucugcgacagcaagcugaugagcgccgccaucaaggacaacagagccgugcacgccgacaugggcuacuggaucgagagcgcccugaacgacaccuggaagaucgagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcagacuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugaugaccaccaucggcaucgugcugcugagccagagcaccauccccgagagcauccuggagcugaccgacgcccuggcccugggcaugauggugcugaagaucgugagaaacauggagaaguaccagcuggccgugaccaucauggccauccugugcgugcccaacgccgugauccuggagaacgccuggaaggugagcugcaccacccuggccguggugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugagaugggaggagcaggccgagaucagcggcagcagccccauccugagcaucaccaucagcgaggacggcagcaugagcaucaagaacgaggaggaggagcagacccugaccauccugaucagaaccggccugcuggugaucagcggccuguuccccgugagcauccccaucaccgccgccgccugguaccugugggaggugaagaagcagagagccggcgugcugugggacgugcccagccccccccccgugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacaagggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucguggacaagaagggcaagguggugggccuguacggcaacggcguggugaccagaagcggcaccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccaucagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacaucaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagagugggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaagauggugcuucgacggcgugaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccaagaacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggacuucggccugggcagcaucaccacccagcagcccgagagcaacauccuggacaucgaccugagacccgccagcgccuggacccuguacgccguggccaccaccuucaucacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggaccccauccccuacgaccccaaguucgagaagcagcugggccaggugaugcugcuggugcugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccgccaacaccagaagaggcaccggcaacaccggcgagacccugggcgagaaguggaagaacagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaaccuggugacccccgagggcaaggugguggaccugggcugcggcagaggcggcuggagcuacuacugcggcggccugaagaacgugaaggaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccguggaggccggcagaacccugagagugcugaaccugguggagaacuggcugaacaacaacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccagcggcaacaucgugagcagcgugaacaugaucagcagaaugcugaucaacagauucaccaugagacacaagaaggccaccuacgagcccgacguggaccugggcagcggcaccagaaacaucggcaucgagagcgagacccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugaagcugcugaccaagcccugggacgugauccccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcggcuucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacauggagggcgagcacaagaagcuggccgaggccaucuucaagcugaccuaccagaacaagguggugagagugcagagacccacccccagaggcaccgugauggacaucaucagcagaagagaccagagaggcagcggccagguggugaccuacggccugaacaccuucaccaacauggaggcccagcugaucagacagauggagggcgagggcguguucaagagcauccagcagcugaccgugaaggaggagaucgccgugaagaacuggcugaucagagugggcagagagagacugagcagaauggccaucagcggcgacgacugcguggugaagccccuggacgacagauucgccagcgcccugaccgcccugaacgacaugggcaaggugagaaaggacauccagcagugggagcccagcagaggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugagagagaccgccugccugggcaagagcuacgcccagauguggagccugauguacuuccacagaagagaccugagacuggccgccaacgccaucugcagcgccgugcccagccacugggugcccaccagcagaaccaccuggagcauccacgccacccacgaguggaugaccaccgaggacaugcugaccguguggaacagaguguggauccaggagaaccccuggauggaggacaagacccccguggagagcugggaggagauccccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 17607 - RNA, 9876 nt, Artificial Sequence
  derived and/or modified CDS sequence (opt4) from DENV-2__KM279606__SS-prME
accgccggcaucaucaucaugaugauccccaccgugauggccuuccaccugaccaccagaaacggcgagccccacaugaucgugagcagacaggagaagggcaagagccugcuguucaagaccgagaacggcgugaacaugugcacccugauggccauggaccugggcgagcugugcgaggacaccaucaccuacaacugcccccugcugagacagaacgagcccgaggacaucgacugcuggugcaacagcaccagcaccugggugaccuacggcaccugcaccgccaccggcgagcacagaagagagaagagaagcguggcccuggugccccacgugggcaugggccuggagaccagaaccgagaccuggaugagcagcgagggcgccuggaagcacgcccagagaaucgagaccuggauccugagacaccccggcuucaccaucauggccgccauccuggccuacaccaucggcaccaccuacuuccagagagugcugaucuucauccugcugaccgccgugacccccagcauggccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcaccccgccacccugagaaaguacugcguggaggccaagcugaccaacaccaccaccgccagcagaugccccacccagggcgagcccagccugaacgaggagcaggacaagagauucgugugcaagcacagcaugguggacagaggcuggggcaacggcugcggccuguucggcaagggcggcaucgugaccugcgccauguucaccugcaagaagaacauggagggcaagguggugcagcccgagaaccuggaguacaccaucgugaucaccccccacagcggcgaggagaacgccgugggcaacgacaccggcaagcacggcaaggagaucaaggugaccccccagagcagcaucaccgaggccgagcugaccggcuacggcaccgugaccauggagugcagccccagaaccggccuggacuucaacgagauggugcugcugcagauggagaacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucgugaucagagugcaguacgagggcgacggcagccccugcaagauccccuucgagaucauggaccuggagaagagacacgugcugggcagacugaucaccgugaaccccaucgugaccgagaaggacaaccccgugaacaucgaggccgagccccccuucggcgacagcuacaucaucaucggcguggagcccggccagcugaagcugagcugguacaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcguggugaucaccuggaucggcaugaacagcagaagcaccagccugagcgugagccuggugcuggugggcguggugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugaccgagaacgaggugaagcugaccaucaugaccggcgacaucaagggcaucaugcaggccggcaagagaagccugagaccccagcccaccgagcugaaguacagcuggaaggccuggggcaaggccaagaugcugagcaccgagcugcacaaccacaccuuccugaucgacggccccgagaccgccgagugccccaacaccaacagagccuggaacagccuggagguggaggacuacggcuucggcguguucaccaccaacaucuggcugaagcugaaggagagacaggacguguucugcgacagcaagcugaugagcgccgccaucaaggacaacagagccgugcacgccgacaugggcuacuggaucgagagcgcccugaacgacaccuggaagaucgagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcagacuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugaugaccaccaucggcaucgugcugcugagccagagcaccauccccgagagcauccuggagcugaccgacgcccuggcccugggcaugauggugcugaagaucgugagaaacauggagaaguaccagcuggccgugaccaucauggccauccugugcgugcccaacgccgugauccuggagaacgccuggaaggugagcugcaccacccuggccguggugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugagaugggaggagcaggccgagaucagcggcagcagccccauccugagcaucaccaucagcgaggacggcagcaugagcaucaagaacgaggaggaggagcagacccugaccauccugaucagaaccggccugcuggugaucagcggccuguuccccgugagcauccccaucaccgccgccgccugguaccugugggaggugaagaagcagagagccggcgugcugugggacgugcccagccccccccccgugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacaagggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucguggacaagaagggcaagguggugggccuguacggcaacggcguggugaccagaagcggcaccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccaucagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacaucaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagagugggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaagauggugcuucgacggcgugaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccaagaacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggacuucggccugggcagcaucaccacccagcagcccgagagcaacauccuggacaucgaccugagacccgccagcgccuggacccuguacgccguggccaccaccuucaucacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggaccccauccccuacgaccccaaguucgagaagcagcugggccaggugaugcugcuggugcugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccgccaacaccagaagaggcaccggcaacaccggcgagacccugggcgagaaguggaagaacagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaaccuggugacccccgagggcaaggugguggaccugggcugcggcagaggcggcuggagcuacuacugcggcggccugaagaacgugaaggaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccguggaggccggcagaacccugagagugcugaaccuggccgagaacuggcugaacaacaacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccagcggcaacaucgugagcagcgugaacaugaucagcagaaugcugaucaacagauucaccaugagacacaagaaggccaccuacgagcccgacguggaccugggcagcggcaccagaaacaucggcaucgagagcgagacccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacgugauccccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcggcuucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacauggagggcgagcacaagaagcuggccgaggccaucuucaagcugaccuaccagaacaagguggugagagugcagagacccacccccagaggcaccgugauggacaucaucagcagaagagaccagagaggcagcggccagguggugaccuacggccugaacaccuucaccaacauggaggcccagcugaucagacagauggagggcgagggcguguucaagagcauccagcagcugaccgugaaggaggagaucgccgugaagaacuggcugaucagagugggcagagagagacugagcagaauggccaucagcggcgacgacugcguggugaagccccuggacgacagauucgccagcgcccugaccgcccugaacgacaugggcaaggugagaaaggacauccagcagugggagcccagcagaggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugagagagaccgccugccugggcaagagcuacgcccagauguggagccugauguacuuccacagaagagaccugagacuggccgccaacgccaucugcagcgccgugcccagccacugggugcccaccagcagaaccaccuggagcauccacgccacccacgaguggaugaccaccgaggacaugcugaccguguggaacagaguguggauccaggagaaccccuggauggaggacaagacccccguggagagcugggaggagauccccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 17608 - RNA, 9876 nt, Artificial Sequence
  derived and/or modified CDS sequence (opt4) from DENV-2__JN851113__SS-prME
accgccggcaucaucaucaugaugauccccaccgugauggccuuccaccugaccaccagaaacggcgagccccacaugaucgugagcagacaggagaagggcaagagccugcuguucaagaccgagaacggcgugaacaugugcacccugauggccauggaccugggcgagcugugcgaggacaccaucaccuacaacugcccccugcugagacagaacgagcccgaggacaucgacugcuggugcaacagcaccagcaccugggugaccuacggcaccugcaccgccaccggcgagcacagaagagagaagagaagcguggcccuggugccccacgugggcaugggccuggagaccagaaccgagaccuggaugagcagcgagggcgccuggaagcacgcccagagaaucgagaccuggauccugagacaccccggcuucaccaucauggccgccauccuggccuacaccaucggcaccaccuacuuccagagagugcugaucuucauccugcugaccgccgugacccccagcauggccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcaccccgccacccugagaaaguacugcguggaggccaagcugaccaacaccaccaccgccagcagaugccccacccagggcgagcccagccugaacgaggagcaggacaagagauucgugugcaagcacagcaugguggacagaggcuggggcaacggcugcggccuguucggcaagggcggcaucgugaccugcgccauguucaccugcaagaagaacauggagggcaagguggugcagcccgagaaccuggaguacaccaucgugaucaccccccacagcggcgaggagaacgccgugggcaacgacaccggcaagcacggcaaggagaucaaggugaccccccagagcagcaucaccgaggccgagcugaccggcuacggcaccgugaccauggagugcagccccagaaccggccuggacuucaacgagauggugcugcugcagauggagaacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucgugaucagagugcaguacgagggcgacggcagccccugcaagauccccuucgagaucauggaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugagcugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcguggugaucaccuggaucggcaugaacagcagaagcaccagccugagcgugagccuggugcuggugggcguggugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugaccgagaacgaggugaagcugaccaucaugaccggcgacaucaagggcaucaugcaggccggcaagagaagccugagaccccagcccaccgagcugaaguacagcuggaaggccuggggcaaggccaagaugcugagcaccgagcugcacaaccacaccuuccugaucgacggccccgagaccgccgagugccccaacaccaacagagccuggaacagccuggagguggaggacuacggcuucggcguguucaccaccaacaucuggcugaagcugaaggagagacaggacguguucugcgacagcaagcugaugagcgccgccaucaaggacaacagagccgugcacgccgacaugggcuacuggaucgagagcgcccugaacgacaccuggaagaucgagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcagacuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugaugaccaccaucggcaucgugcugcugagccagagcaccauccccgagagcauccuggagcugaccgacgcccuggcccugggcaugauggugcugaagaucgugagaaacauggagaaguaccagcuggccgugaccaucauggccauccugugcgugcccaacgccgugauccugcagaacgccuggaaggugagcugcaccacccuggccguggugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugagaugggaggagcaggccgagaucagcggcagcagccccauccugagcaucaccaucagcgaggacggcagcaugagcaucaagaacgaggaggaggagcagacccugaccauccugaucagaaccggccugcuggugaucagcggccuguuccccgugagcauccccaucaccgccgccgccugguaccugugggaggugaagaagcagagagccggcgugcugugggacgugcccagccccccccccgugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacaagggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucguggacaagaagggcaagguggugggccuguacggcaacggcguggugaccagaagcggcaccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccaucagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacaucaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagagugggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacagaguggccgccgagggcaucaacuacgccgacagaagauggugcuucgacggcgugaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccaagaacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggacuucggccugggcagcaucaccacccagcagcccgagagcaacauccuggacaucgaccugagacccgccagcgccuggacccuguacgccguggccaccaccuucaucacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaugaccgugaucgaccuggaccccauccccuacgaccccaaguucgagaagcagcugggccaggugaugcugcuggugcugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccgccaacaccagaagaggcaccggcaacaccggcgagacccugggcgagaaguggaagaacagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaaccuggugacccccgagggcaaggugguggaccugggcugcggcagaggcggcuggagcuacuacugcggcggccugaagaacgugaaggaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccguggaggccggcagaacccugagagugcugaaccugguggagaacuggcugaacaacaacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccagcggcaacaucgugagcagcgugaacaugaucagcagaaugcugaucaacagauucaccaugagacacaagaaggccaccuacgagcccgacguggaccugggcagcggcaccagaaacaucggcaucgagagcgagacccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacgugauccccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcggcuucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacauggagggcgagcacaagaagcuggccgaggccaucuucaagcugaccuaccagaacaagguggugagagugcagagacccacccccagaggcaccgugauggacaucaucagcagaagagaccagagaggcagcggccagguggugaccuacggccugaacaccuucaccaacauggaggcccagcugaucagacagauggagggcgagggcguguucaagagcauccagcagcugaccgugaaggaggagaucgccgugaagaacuggcugaucagagugggcagagagagacugagcagaauggccaucagcggcgacgacugcguggugaagccccuggacgacagauucgccagcgcccugaccgcccugaacgacaugggcaaggugagaaaggacauccagcagugggagcccagcagaggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugagagagaccgccugccugggcaagagcuacgcccagauguggagccugauguacuuccacagaagagaccugagacuggccgccaacgccaucugcagcgccgugcccagccacugggugcccaccagcagaaccaccuggagcauccacgccacccacgaguggaugaccaccgaggacaugcugaccguguggaacagaguguggauccaggagaaccccuggauggaggacaagacccccguggagagcugggaggagauccccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 17609 - RNA, 9876 nt, Artificial Sequence
  derived and/or modified CDS sequence (opt4) from DENV-2__GU370050__SS-prME
accgccggcaucaucaucaugaugauccccaccgugauggccuuccaccugaccaccagaaacggcgagccccacaugaucgugagcagacaggagaagggcaagagccugcuguucaagaccgagaacggcgugaacaugugcacccugauggccauggaccugggcgagcugugcgaggacaccaucaccuacaacugcccccugcugagacagaacgagcccgaggacaucgacugcuggugcaacagcaccagcaccugggugaccuacggcaccugcaccgccaccggcgagcacagaagagagaagagaagcguggcccuggugccccacgugggcaugggccuggagaccagaaccgagaccuggaugagcagcgagggcgccuggaagcacgcccagagaaucgagaccuggauccugagacaccccggcuucaccaucauggccgccauccuggccuacaccaucggcaccaccuacuuccagagagugcugaucuucauccugcugaccgccgugacccccagcauggccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcaccccgccacccugagaaaguacugcguggaggccaagcugaccaacaccaccaccgccagcagaugccccacccagggcgagcccagccugaacgaggagcaggacaagagauucgugugcaagcacagcaugguggacagaggcuggggcaacggcugcggccuguucggcaagggcggcaucgugaccugcgccauguucaccugcaagaagaacauggagggcaagguggugcagcccgagaaccuggaguacaccaucgugaucaccccccacagcggcgaggagaacgccgugggcaacgacaccggcaagcacggcaaggagaucaaggugaccccccagagcagcaucaccgaggccgagcugaccggcuacggcaccgugaccauggagugcagccccagaaccggccuggacuucaacgagauggugcugcugcagauggagaacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucgugaucagagugcaguacgagggcgacggcagccccugcaagauccccuucgagaucauggaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugagcugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcguggugaucaccuggaucggcaugaacagcagaagcaccagccugagcgugagccuggugcuggugggcguggugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugaccgagaacgaggugaagcugaccaucaugaccggcgacaucaagggcaucaugcaggccggcaagagaagccugagaccccagcccaccgagcugaaguacagcuggaaggccuggggcaaggccaagaugcugagcaccgagcugcacaaccacaccuuccugaucgacggccccgagaccgccgagugccccaacaccaacagagccuggaacagccuggagguggaggacuacggcuucggcguguucaccaccaacaucuggcugaagcugaaggagagacaggacguguucugcgacagcaagcugaugagcgccgccaucaaggacaacagagccgugcacgccgacaugggcuacuggaucgagagcgcccugaacgacaccuggaagaucgagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcagacuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugaugaccaccaucggcaucgugcugcugagccagagcaccauccccgagagcauccuggagcugaccgacgcccuggcccugggcaugauggugcugaagaucgugagaaacauggagaaguaccagcuggccgugaccaucauggccauccugugcgugcccaacgccgugauccugcagaacgccuggaaggugagcugcaccacccuggccguggugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugagaugggaggagcaggccgagaucagcggcagcagccccauccugagcaucaccaucagcgaggacggcagcaugagcaucaagaacgaggaggaggagcagacccugaccauccugaucagaaccggccugcuggugaucagcggccuguuccccgugagcauccccaucaccgccgccgccugguaccugugggaggugaagaagcagagagccggcgugcugugggacgugcccagccccccccccgugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacaagggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucguggacaagaagggcaagguggugggccuguacggcaacggcguggugaccagaagcggcaccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccaucagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacaucaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagagugggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacagaguggccgccgagggcaucaacuacgccgacagaagauggugcuucgacggcgugaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccaagaacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggacuucggccugggcagcaucaccacccagcagcccgagagcaacauccuggacaucgaccugagacccgccagcgccuggacccuguacgccguggccaccaccuucaucacccccauccugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaugaccgugaucgaccuggaccccauccccuacgaccccaaguucgagaagcagcugggccaggugaugcugcuggugcugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccgccaacaccagaagaggcaccggcaacaccggcgagacccugggcgagaaguggaagaacagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaaccuggugacccccgagggcaaggugguggaccugggcugcggcagaggcggcuggagcuacuacugcggcggccugaagaacgugaaggaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccguggaggccggcagaacccugagagugcugaaccugguggagaacuggcugaacaacaacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccagcggcaacaucgugagcagcgugaacaugaucagcagaaugcugaucaacagauucaccaugagacacaagaaggccaccuacgagcccgacguggaccugggcagcggcaccagaaacaucggcaucgagagcgagacccccaaccuggacaucaucggcaagagaaucgagaagaucaagcaggagcacaagaccagcuggcacuacgaccaggaccaccccuacaagaccugggccuaccacggcagcuacgagaccaagcagaccggcagcgccagcagcauggugaacggcguggugagacugcugaccaagcccugggacgugauccccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcggcuucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacauggagggcgagcacaagaagcuggccgaggccaucuucagacugaccuaccagaacaagguggugagagugcagagacccacccccagaggcaccgugauggacaucaucagcagaagagaccagagaggcagcggccagguggugaccuacggccugaacaccuucaccaacauggaggcccagcugaucagacagauggagggcgagggcguguucaagagcauccagcagcugaccgugaaggaggagaucgccgugaagaacuggcugaucagagugggcagagagagacugagcagaauggccaucagcggcgacgacugcguggugaagccccuggacgacagauucgccagcgcccugaccgcccugaacgacaugggcaaggugagaaaggacauccagcagugggagcccagcagaggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugagagagaccgccugccugggcaagagcuacgcccagauguggagccugauguacuuccacagaagagaccugagacuggccgccaacgccaucugcagcgccgugcccagccacugggugcccaccagcagaaccaccuggagcauccacgccacccacgaguggaugaccaccgaggacaugcugaccguguggaacagaguguggauccaggagaaccccuggauggaggacaagacccccguggagagcugggaggagauccccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 17610 - RNA, 9876 nt, Artificial Sequence
  derived and/or modified CDS sequence (opt4) from DENV-2__JN851129__SS-prME
accgccggcaucaucaucaugaugauccccaccgugauggccuuccaccugaccaccagaaacggcgagccccacaugaucgugagcagacaggagaagggcaagagccugcuguucaagaccgagaacggcgugaacaugugcacccugauggccauggaccugggcgagcugugcgaggacaccaucaccuacaacugcccccugcugagacagaacgagcccgaggacaucgacugcuggugcaacagcaccagcaccugggugaccuacggcaccugcaccgccaccggcgagcacagaagagagaagagaagcguggcccuggugccccacgugggcaugggccuggagaccagaaccgagaccuggaugagcagcgagggcgccuggaagcacgcccagagaaucgagaccugggugcugagacaccccggcuucaccaucauggccgccauccuggccuacaccaucggcaccaccuacuuccagagagugcugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcaccccgccacccugagaaaguacugcaucgaggccaagcugaccaacaccaccaccgccagcagaugccccacccagggcgagcccagccugagcgaggagcaggacaagagauucgugugcaagcacagcaugguggacagaggcuggggcaacggcugcggccuguucggcaagggcggcaucgugaccugcgccauguucaccugcaagaagaacauggagggcaagguggugcagcccgagaaccuggaguacaccaucgugaucaccccccacagcggcgaggagaacgccgugggcaacgacaccggcaagcacggcaaggagaucaaggugaccccccagagcagcaucaccgaggccgagcugaccggcuacggcaccgugaccauggagugcagccccagaaccggccuggacuucaacgagauggugcugcugcagauggagaacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucgugaucagagugcaguacgagggcgacggcagccccugcaagauccccuucgagaucauggaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugagcugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcguggugaucaccuggaucggcaugaacagcagaagcaccagccugagcgugagccuggugcuggugggcguggugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaaggccuggggcaaggccaagaugcugagcaccgagcugcacaaccacaccuuccugaucgacggccccgagaccgccgagugccccaacaccaacagagccuggaacagccuggagguggaggacuacggcuucggcguguucaccaccaaccuguggcugaagcugaaggagagacaggacguguucugcgacagcaagcugaugagcgccgccaucaaggacaacagagccgugcacgccgacaugggcuacuggaucgagagcgcccugaacgacaccuggaagaucgagaaggccagcuucaucgaggugaagagcugccacuggcccaagagccacacccuguggagcaacggcgugcuggagagcgagaugaucauccccaagagcuucgccggccccgugagccagcacaacuacagacccggcuaccacacccagaccgccggccccuggcaccugggcagacuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugaugaccaccaucggcaucgugcugcugagccagagcaccauccccgagaccauccuggagcugaccgacgcccuggcccugggcaugauggugcugaagaucgugagaaacauggagaaguaccagcuggccgugaccaucauggccauccugugcgugcccaacgccgugauccugcagaacgccuggaaggugagcugcaccacccuggccguggugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugagaugggaggagcaggccgagaucagcggcagcagccccauccugagcaucaccaucagcgaggacggcagcaugagcaucaagaacgaggaggaggagcagacccugaccauccugaucagaaccggccugcuggugaucagcggccuguuccccgugagcauccccaucaccgccgccgccugguaccugugggaggugaagaagcagagagccggcgugcugugggacgugcccagccccccccccgugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacaagggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucguggacaagaagggcaagguggugggccuguacggcaacggcguggugaccagaagcggcaccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccaucagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacaucaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagagugggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacagaguggccgccgagggcaucaacuacgccgacagaagauggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagaaacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggacuucggccugggcagcaucaccacccagcagcccgagagcaacauccuggacaucgaccugagacccgccagcgccuggacccuguacgccguggccaccaccuucaucacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggaccccauccccuacgaccccaaguucgagaagcagcugggccaggugaugcugcuggugcugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccgccaacaccagaagaggcaccggcaacaccggcgagacccugggcgagaaguggaagaacagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaaccuggugacccccgagggcaaggugguggaccugggcugcggcagaggcggcuggagcuacuacugcggcggccugaagaacgugaaggaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccguggaggccggcagaacccugagagugcugaaccugguggagaacuggcugaacaacaacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccagcggcaacaucgugagcagcgugaacaugaucagcagaaugcugaucaacagauucaccaugagacacaagaaggccaccuacgagcccgacguggaccugggcagcggcaccagaaacaucggcaucgagagcgagacccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacaucauccccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcggcuucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacauggagggcgagcacaagaagcuggccgaggccaucuucaagcugaccuaccagaacaagguggugagagugcagagacccacccccagaggcaccgugauggacaucaucagcagaagagaccagagaggcagcggccagguggugaccuacggccugaacaccuucaccaacauggaggcccagcugaucagacagauggagggcgagggcguguucaagagcauccagcagcugaccgugaccgaggagaucgccgugaagaacuggcuggugagagugggcagagagagacugagcagaauggccaucagcggcgacgacugcguggugaagccccuggacgacagauucgccagcgcccugaccgcccugaacgacaugggcaaggugagaaaggacauccagcagugggagcccagcagaggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugagagagaccgccugccugggcaagagcuacgcccagauguggagccugauguacuuccacagaagagaccugagacuggccgccaacgccaucugcagcgccgugcccagccacugggugcccaccagcagaaccaccuggagcauccacgccacccacgaguggaugaccaccgaggacaugcugaccguguggaacagaguguggauccaggagaaccccuggauggaggacaagacccugguggagagcugggaggagauccccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 17611 - RNA, 9876 nt, Artificial Sequence
  derived and/or modified CDS sequence (opt4) from DENV-2__JN851128__SS-prME
accgccggcaucaucaucaugaugauccccaccgugauggccuuccaccugaccaccagaaacggcgagccccacaugaucgugagcagacaggagaagggcaagagccugcuguucaagaccgagaacggcgugaacaugugcacccugauggccauggaccugggcgagcugugcgaggacaccaucaccuacaacugcccccugcugagacagaacgagcccgaggacaucgacugcuggugcaacagcaccagcaccugggugaccuacggcaccugcaccgccaccggcgagcacagaagagagaagagaagcguggcccuggugccccacgugggcaugggccuggagaccagaaccgagaccuggaugagcagcgagggcgccuggaagcacgcccagagaaucgagaccugggugcugagacaccccggcuucaccaucauggccgccauccuggccuacaccaucggcaccaccuacuuccagagagugcugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaaccaccccgccacccugagaaaguacugcaucgaggccaagcugaccaacaccaccaccgccagcagaugccccacccagggcgagcccagccugagcgaggagcaggacaagagauucgugugcaagcacagcaugguggacagaggcuggggcaacggcugcggccuguucggcaagggcggcaucgugaccugcgccauguucaccugcaagaagaacauggagggcaagguggugcagcccgagaaccuggaguacaccaucgugaucaccccccacagcggcgaggagaacgccgugggcaacgacaccggcaagcacggcaaggagaucaaggugaccccccagagcagcaucaccgaggccgagcugaccggcuacggcaccgugaccauggagugcagccccagaaccggccuggacuucaacgagauggugcugcugcagauggagaacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucgugaucagagugcaguacgagggcgacggcagccccugcaagauccccuucgagaucauggaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugagcugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcguggugaucaccuggaucggcaugaacagcagaagcaccagccugagcgugagccuggugcuggugggcguggugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaaggccuggggcaaggccaagaugcugagcaccgagcugcacaaccacaccuuccugaucgacggccccgagaccgccgagugccccaacaccaacagagccuggaacagccuggagguggaggacuacggcuucggcguguucaccaccaaccuguggcugaagcugaaggagagacaggacguguucugcgacagcaagcugaugagcgccgccaucaaggacaacagagccgugcacgccgacaugggcuacuggaucgagagcgccaucaacgacaccuggaagaucgagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcagacuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugaugaccaccaucggcaucgugcugcugagccagagcaccauccccgagaccauccuggagcugaccgacgcccuggcccugggcaugaugauccugaagaucgugagaaacauggagaaguaccagcuggccgugaccaucauggccauccugugcgugcccaacgccgugauccugcagaacgccuggaaggugagcugcaccacccuggccguggugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugagaugggaggagcaggccgagaucagcggcagcagccccauccugagcaucaccaucagcgaggacggcagcaugagcaucaagaacgaggaggaggagcagacccugaccauccugaucagaaccggccugcuggugaucagcggccuguuccccgugagcauccccaucaccgccgccgccugguaccugugggaggugaagaagcagagagccggcgugcugugggacgugcccagccccccccccgugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacaagggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucguggacaagaagggcaagguggugggccuguacggcaacggcguggugaccagaagcggcaccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccaucagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacaucaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagagugggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacagaguggccgccgagggcaucaacuacgccgacagaagauggugcuucgacggcgugaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagaaacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggacuucggccugggcagcaucaccacccagcagcccgagagcaacauccuggacaucgaccugagacccgccagcgccuggacccuguacgccguggccaccaccuucaucacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggaccccauccccuacgaccccaaguucgagaagcagcugggccaggugaugcugcuggugcugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccgccaacaccagaagaggcaccggcaacaccggcgagacccugggcgagaaguggaagaacagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaaccuggugacccccgagggcaaggugguggaccugggcugcggcagaggcggcuggagcuacuacugcggcggccugaagaacgugaaggaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccguggaggccggcagaacccugagagugcugaaccugguggagaacuggcugaacaacaacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccagcggcaacaucgugagcagcgugaacaugaucagcagaaugcugaucaacagauucaccaugagacacaagaaggccaccuacgagcccgacguggaccugggcagcggcaccagaaacaucggcaucgagagcgagacccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacaucauccccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcggcuucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacauggagggcgagcacaagaagcuggccgaggccaucuucaagcugaccuaccagaacaagguggugagagugcagagacccacccccagaggcaccgugauggacaucaucagcagaagagaccagagaggcagcggccagguggugaccuacggccugaacaccuucaccaacauggaggcccagcugaucagacagauggagggcgagggcguguucaagagcauccagcagcugaccgugaccgaggagaucgccgugaagaacuggcuggugagagugggcagagagagacugagcagaauggccaucagcggcgacgacugcguggugaagccccuggacgacagauucgccagcgcccugaccgcccugaacgacaugggcaaggugagaaaggacauccagcagugggagcccagcagaggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugagagagaccgccugccugggcaagagcuacgcccagauguggagccugauguacuuccacagaagagaccugagacuggccgccaacgccaucugcagcgccgugcccagccacugggugcccaccagcagaaccaccuggagcauccacgccacccacgaguggaugaccaccgaggacaugcugaccguguggaacagaguguggauccaggagaaccccuggauggaggacaagacccugguggagagcugggaggagauccccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 17612 - RNA, 9876 nt, Artificial Sequence
  derived and/or modified CDS sequence (opt4) from DENV-2__JN851130__SS-prME
accgccggcaucaucaucaugaugauccccaccgugauggccuuccaccugaccaccagaaacggcgagccccacaugaucgugagcagacaggagaagggcaagagccugcuguucaagaccgagaacggcgugaacaugugcacccugauggccauggaccugggcgagcugugcgaggacaccaucaccuacaacugcccccugcugagacagaacgagcccgaggacaucgacugcuggugcaacagcaccagcaccugggugaccuacggcaccugcaccgccaccggcgagcacagaagagagaagagaagcguggcccuggugccccacgugggcaugggccuggagaccagaaccgagaccuggaugagcagcgagggcgccuggaagcacgcccagagaaucgagaccugggugcugagacaccccggcuucaccaucauggccgccauccuggccuacaccaucggcaccaccuacuuccagagagugcugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcaccccgccacccugagaaaguacugcaucgaggccaagcugaccaacaccaccaccgccagcagaugccccacccagggcgagcccagccugaacgaggagcaggacaagagauucgugugcaagcacagcaugguggacagaggcuggggcaacggcugcggccuguucggcaagggcggcaucgugaccugcgccauguucaccugcaagaagaacauggagggcaagaucgugcagcccgagaaccuggaguacaccaucgugaucaccccccacagcggcgaggagaacgccgugggcaacgacaccggcaagcacggcaaggagaucaaggugaccccccagagcagcaucaccgaggccgagcugaccggcuacggcaccgugaccauggagugcagccccagaaccggccuggacuucaacgagauggugcugcugcagauggagaacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucgugaucagagugcaguacgagggcgacggcagccccugcaagauccccuucgagaucauggaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugagcugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcguggugaucaccuggaucggcaugaacagcagaagcaccagccugagcgugagccuggugcuggugggcguggugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagcugcacaaccacaccuuccugaucgacggccccgagaccgccgagugccccaacaccaacagagccuggaacagccuggagguggaggacuacggcuucggcguguucaccaccaacaucuggcugaagcugaaggagagacaggacguguucugcgacagcaagcugaugagcgccgccaucaaggacaacagagccgugcacgccgacaugggcuacuggaucgagagcgcccugaacgacaccuggaagaucgagaaggccagcuucaucgaggugaagagcugcuacuggcccaagagccacacccuguggagcaacggcgugcuggagagcgagaugaucauccccaagaacuucgccggccccgugagccagcacaacuacagacccggcuaccacacccagaccgccggccccuggcaccugggcagacuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugaugaccaccaucggcaucgugcugcugagccagagcaccauccccgagaccauccuggagcugaccgacgcccuggcccugggcaugauggcccugaagaucgugagaaacauggagaaguaccagcuggccgugaccaucauggccauccugugcgugcccaacgccgugauccugcagaacgccuggaaggugagcugcaccacccuggccguggugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugagaugggaggagcaggccgagaucagcggcagcagccccauccugagcaucaccaucagcgaggacggcagcaugagcaucaagaacgaggaggaggagcagacccugaccauccugaucagaaccggccugcuggugaucagcggccuguuccccgugagcauccccaucaccgccgccgccugguaccugugggaggugaagaagcagagagccggcgugcugugggacgugcccagccccccccccgugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacaagggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucguggacaagaagggcaagguggugggccuguacggcaacggcguggugaccagaagcggcaccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccaucagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacaucaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagagugggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacagaguggccgccgagggcaucaacuacgccgacagaagauggugcuucgacggcgugaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagaaacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggacuucggccugggcagcaucaccacccagcagcccgagagcaacauccuggacaucgaccugagacccgccagcgccuggacccuguacgccguggccaccaccuucaucacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggaccccauccccuacgaccccaaguucgagaagcagcugggccaggugaugcugcuggugcugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccgccaacaccagaagaggcaccggcaacaccggcgagacccugggcgagaaguggaagaacagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaaccuggugacccccgagggcaaggugguggaccugggcugcggcagaggcggcuggagcuacuacugcggcggccugaagaacgugaaggaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccguggaggccggcagaacccugagagugcugaaccugguggagaacuggcugaacaacaacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccagcggcaacaucgugagcagcgugaacaugaucagcagaaugcugaucaacagauucaccaugagacacaagaaggccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacgugauccccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcggcuucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacauggagggcgagcacaagaagcuggccgaggccaucuucaagcugaccuaccagaacaagguggugagagugcagagacccacccccagaggcaccgugauggacaucaucagcagaagagaccagagaggcagcggccagguggugaccuacggccugaacaccuucaccaacauggaggcccagcugaucagacagauggagggcgagggcguguucaagagcauccagcagcugaccgugaccgaggagaucgccgugaagaacuggcuggugagagugggcagagagagacugagcagaauggccaucagcggcgacgacugcguggugaagccccuggacgacagauucgccagcgcccugaccgcccugaacgacaugggcaaggugagaaaggacauccagcagugggagcccagcagaggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugagagagaccgccugccugggcaagagcuacgcccagauguggagccugauguacuuccacagaagagaccugagacuggccgccaacgccaucugcagcgccgugcccagccacugggugcccaccagcagaaccaccuggagcauccacgccacccacgaguggaugaccaccgaggacaugcugaccguguggaacagaguguggauccaggagaaccccuggauggaggacaagacccccguggagagcugggaggagauccccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 17613 - RNA, 9876 nt, Artificial Sequence
  derived and/or modified CDS sequence (opt4) from DENV-2__JN851125__SS-prME
accgccggcaucaucaucaugaugauccccaccgugauggccuuccaccugaccaccagaaacggcgagccccacaugaucgugagcagacaggagaagggcaagagccugcuguucaagaccgagaacggcgugaacaugugcacccugauggccauggaccugggcgagcugugcgaggacaccaucaccuacaacugcccccugcugaagcagaacgagcccgaggacaucgacugcuggugcaacagcaccagcaccugggugaccuacggcaccugcaccgccaccggcgagcacagaagagagaagagaagcguggcccuggugccccacgugggcaugggccuggagaccagaaccgagaccuggaugagcagcgagggcgccuggaagcacgcccagagaaucgagaccugggugcugagacaccccggcuucaccgugauggccgccauccuggccuacaccaucggcaccaccuacuuccagagagugcugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcaccccgccacccugagaaaguacugcaucgaggccaagcugaccaacaccaccaccgccagcagaugccccacccagggcgagcccagccugaacgaggagcaggacaagagauucgugugcaagcacagcaugguggacagaggcuggggcaacggcugcggccuguucggcaagggcggcaucgugaccugcgccauguucaccugcaagaagaacauggagggcaagguggugcagcccgagaaccuggaguacaccaucgugaucaccccccacagcggcgaggagaacgccgugggcaacgacaccggcaagcacggcaaggagaucaaggugaccccccagagcagcaucaccgaggccgagcugaccggcuacggcaccgugaccauggagugcagccccagaaccggccuggacuucaacgagauggugcugcugcagauggagaacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucgugaucagagugcaguacgagggcgacggcagccccugcaagauccccuucgagaucauggaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugagcugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcguggugaucaccuggaucggcaugaacagcagaagcaccagccugagcgugagccuggugcuggugggcguggugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagaugaccaucaugaccggcgacaucaagggcaucaugcaggccggcaagagaagccugagaccccagcccaccgagcugaaguacagcuggaaggccuggggcaaggccaagaugcugagcaccgagcugcacaaccacaccuuccugaucgacggccccgagaccgccgagugccccaacaccaacagagccuggaacagccuggagguggaggacuacggcuucggcguguucaccaccaacaucuggcugaagcugaaggagagacaggacgugagcugcgacagcaagcugaugagcgccgccaucaaggacaacagagccgugcacgccgacaugggcuacuggaucgagagcgcccugaacgacaccuggaagaucgagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcagacuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugaugaccaccaucggcaucgugcugcugagccagagcaccauccccgagaccauccuggagcugaccgacgcccuggcccugggcaugauggugcugaagguggugagaaacauggagaaguaccagcuggccgugaccaucauggccauccugugcgugcccaacgccgugauccugcagaacgccuggaaggugagcugcaccacccuggccguggugagcguguucccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugagaugggaggagcaggccgagaucagcggcagcagccccauccugagcaucaccaucagcgaggacggcagcaugagcaucaagaacgaggaggaggagcagacccugaccauccugaucagaaccggccugcuggugaucagcggccuguuccccgugagcauccccaucaccgccgccgccugguaccugugggaggugaagaagcagagagccggcgugcugugggacgugcccagccccccccccgugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacaagggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucguggacaagaagggcaagguggugggccuguacggcaacggcguggugaccagaagcggcaccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccaucagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacaucaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagagugggcagaaaccccaagaacgagagcgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacagaguggccgccgagggcaucaacuacgccgacagaagauggugcuucgacggcgugaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagaaacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggacuucggccugggcagcagcaccacccagcagcacgagagcaacauccuggacaucgaccugagacccgccagcgccuggacccuguacgccguggccaccaccuucaucacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugagccugguggcccacuacgccaucaucggccccggccugcaggccaaggccaccagagaggcccagaagagagccgccgccggcaucaugaagaaccccaccguggacggcaucaccgugaucgaccuggaccccauccccuacgaccccaaguucgagaagcagcugggccaggugaugcugcuggugcugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccgccaacaccagaagaggcaccggcaacaccggcgagacccugggcgagaaguggaagaacagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaaccuggugacccccgagggcaaggugguggaccugggcugcggcagaggcggcuggagcuacuacugcggcggccugaagaacgugaaggaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccguggaggccggcagaacccugagagugcugaaccugguggagaacuggcugaacaacaacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccagcggcaacaucgugagcagcgugaacaugaucagcagaaugcugaucaacagauucaccaugagacacaagaaggccaccuacgagcccgacguggaccugggcagcggcaccagaaacaucggcaucgagagcgagacccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacgugauccccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcggcuucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacauggagggcgagcacaagaagcuggccgaggccaucuucaagcugaccuaccagaacaagguggugagagugcagagacccacccccagaggcaccgugauggacaucaucagcagaagagaccagagaggcagcggccagguggugaccuacggccugaacaccuucaccaacauggaggcccagcugaucagacagauggagggcgagggcguguucaagagcauccagcagcugaccgccaccgaggagaucgccgugaagaacuggcuggugagagugggcagagagagacugagcagaauggccaucagcggcgacgacugcguggugaagccccuggacgacagauucgccagcgcccugaccgcccugaacgacaugggcaaggugagaaaggacauccagcagugggagcccagcagaggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugagagagaccgccugccugggcaagagcuacgcccagauguggagccugauguacuuccacagaagagaccugagacuggccgccaacgccaucugcagcgccgugcccagccacugggugcccaccagcagaaccaccuggagcauccacgccacccacgaguggaugaccaccgaggacaugcugaccguguggaacagaguguggauccaggagaaccccuggauggaggacaagacccccguggagagcugggaggagauccccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 17614 - RNA, 9876 nt, Artificial Sequence
  derived and/or modified CDS sequence (opt4) from DENV-2__JN851123__SS-prME
accgccggcaucaucaucaugaugauccccaccgugauggccuuccaccugaccaccagaaacggcgagccccacaugaucgugagcagacaggagaagggcaagagccugcuguucaagaccgagaacggcgugaacaugugcacccugauggccauggaccugggcgagcugugcgaggacaccaucaccuacaacugcccccugcugaagcagaacgagcccgaggacaucgacugcuggugcaacagcaccagcaccugggugaccuacggcaccugcaccgccaccggcgagcacagaagagagaagagaagcguggcccuggugccccacgugggcaugggccuggagaccagaaccgagaccuggaugagcagcgagggcgccuggaagcacgcccagagaaucgagaccugggugcugagacaccccggcuucaccaucauggccgccauccuggccuacaccaucggcaccaccuacuuccagagagugcugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcaccccgccacccugagaaaguacugcaucgaggccaagcugaccaacaccaccaccgccagcagaugccccacccagggcgagcccagccugaacgaggagcaggacaagagauucgugugcaagcacagcaugguggacagaggcuggggcaacggcugcggccuguucggcaagggcggcaucgugaccugcgccauguucaccugcaagaagaacauggagggcaagaucgugcagcccgagaaccuggaguacaccaucgugaucaccccccacagcggcgaggagaacgccgugggcaacgacaccggcaagcacggcaaggagaucaaggugaccccccagagcagcaucaccgaggccgagcugaccggcuacggcaccgugaccauggagugcagccccagaaccggccuggacuucaacgagauggugcugcugcagauggagaacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucgugaucagagugcaguacgagggcgacggcagccccugcaagauccccuucgagaucauggaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugagcugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcguggugaucaccuggaucggcaugaacagcagaagcaccagccugagcgugagccuggugcuggugggcguggugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgagaucaagcugaccaucaugaccggcgacaucaagggcaucaugcaggccggcaagagaagccugagaccccagcccaccgagcugaaguacagcuggaaggccuggggcaaggccaagaugcugagcaccgagcugcacaaccacaccuuccugaucgacggccccgagaccgccgagugccccaacaccaacagagccuggaacagccuggagguggaggacuacggcuucggcguguucaccaccaacaucuggcugaagcugaaggagagacaggacguguucugcgacagcaagcugaugagcgccgccaucaaggacaacagagccgugcacgccgacaugggcuacuggaucgagagcgcccugaacgacaccuggaagaucgagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcagacuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugaugaccaccaucggcaucgugcugcugagccagagcaccauccccgagaccauccuggagcugaccgacgcccuggcccugggcaugauggugcugaagaucgugagaaacauggagaaguaccagcuggccgugaccaucauggccauccugugcgugcccaacgccgugauccugcagaacgccuggaaggugagcugcaccacccuggccguggugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugagaugggaggagcaggccgagaucagcggcagcagccccauccugagcaucaccaucagcgaggacggcagcaugagcaucaagaacgaggaggaggagcagacccugaccauccugaucagaaccggccugcuggugaucagcggccuguuccccgugagcauccccaucaccgccgccgccugguaccugugggaggugaagaagcagagagccggcgugcugugggacgugcccagccccccccccgugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacaagggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucguggacaagaagggcaagguggugggccuguacggcaacggcguggugaccagaagcggcaccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccaucagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacaucaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagagugggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacagaguggccgccgagggcaucaacuacgccgacagaagauggugcuucgacggcgugaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagaaacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggacuucggccugggcagcaucaccacccagcagcccgagagcaacauccuggacaucgaccugagacccgccagcgccuggacccuguacgccguggccaccaccuucaucacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggaccccauccccuacgaccccaaguucgagaagcagcugggccaggugaugcugcuggugcugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccgccaacaccagaagaggcaccggcaacaccggcgagacccugggcgagaaguggaagaacagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucaucgagagaaaccuggugacccccgagggcaaggugguggaccugggcugcggcagaggcggcuggagcuacuacugcggcggccugaagaacgugaaggaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccguggaggccggcagaacccugagagugcugaaccugguggagaacuggcugaacaacaacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccagcggcaacaucgugagcagcgugaacaugaucagcagaaugcugaucaacagauucaccaugagacacaagaaggccaccuacgagcccgacguggaccugggcagcggcaccagaaacaucggcaucgagagcgagacccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacgugauccccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcggcuucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacauggagggcgagcacaagaagcuggccgaggccaucuucagacugaccuaccagaacaagguggugagagugcagagacccacccccagaggcaccgugauggacaucaucagcagaagagaccagagaggcagcggccagguggugaccuacggccugaacaccuucaccaacauggaggcccagcugaucagacagauggagggcgagggcguguucaagagcauccagcaccugaccgugaccgaggagaucgccgugaagaacuggcuggugagagugggcagagagagacugagcagaauggccaucagcggcgacgacugcguggugaagccccuggacgacagauucgccagcgcccugaccgcccugaacgacaugggcaaggugagaaaggacauccagcagugggagcccagcagaggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugagagagaccgccugccugggcaagagcuacgcccagauguggagccugauguacuuccacagaagagaccugagacuggccgccaacgccaucugcagcgccgugcccagccacugggugcccaccagcagaaccaccuggagcauccacgccacccacgaguggaugaccaccgaggacaugcugaccguguggaacagaguguggauccaggagaaccccuggauggaggacaagacccccaucgagagcugggaggagauccccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 17615 - RNA, 9876 nt, Artificial Sequence
  derived and/or modified CDS sequence (opt4) from DENV-2__JN851118__SS-prME
accgccggcaucaucaucaugaugauccccaccgugauggccuuccaccugaccaccagaaacggcgagccccacaugaucgugagcagacaggagaagggcaagagccugcuguucaagaccgagaacggcgugaacaugugcacccugauggccauggaccugggcgagcugugcgaggacaccaucaccuacaacugcccccugcugagacagaacgagcccgaggacaucgacugcuggugcaacagcaccagcaccugggugaccuacggcaccugcaccgccaccggcgagcacagaagagagaagagaagcguggcccuggugccccacgugggcaugggccuggagaccagaaccgagaccuggaugagcagcgagggcgccuggaagcacgcccagagaaucgagaccuggauccugagacaccccggcuucaccaucauggccgccauccuggccuacaccaucggcaccaccuacuuccagagagugcugaucuucauccugcugaccgccgugacccccagcauggccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcaccccgccacccugagaaaguacugcguggaggccaagcugaccaacaccaccaccgccagcagaugccccacccagggcgagcccagccugaacgaggagcaggacaagagauucgugugcaagcacagcaugguggacagaggcuggggcaacggcugcggccuguucggcaagggcggcaucgugaccugcgccauguucaccugcaagaagaacauggagggcaagguggugcagcccgagaaccuggaguacaccaucgugaucaccccccacagcggcgaggagaacgccgugggcaacgacaccggcaagcacggcaaggagaucaaggugaccccccagagcagcaucaccgaggccgagcugaccggcuacggcaccgugaccauggagugcagccccagaaccggccuggacuucaacgagauggugcugcugcagauggagaacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucgugaucagagugcaguacgagggcgacggcagccccugcaagauccccuucgagaucauggaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugagcugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcguggugaucaccuggaucggcaugaacagcagaagcaccagccugagcgugagccuggugcuggugggcguggugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugaccgagaacgaggugaagcugaccaucaugaccggcgacaucaagggcaucaugcaggccggcaagagaagccugagaccccagcccaccgagcugaaguacagcuggaaggccuggggcaaggccaagaugcugagcaccgagcugcacaaccacaccuuccugaucgacggccccgagaccgccgagugccccaacaccaacagagccuggaacagccuggagguggaggacuacggcuucggcguguucaccaccaacaucuggcugaagcugaaggagagacaggacguguucugcgacagcaagcugaugagcgccgccaucaaggacaacagagccgugcacgccgacaugggcuacuggaucgagagcgcccugaacgacaccuggaagaucgagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcagacuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugaugaccaccaucggcaucgugcugcugagccagagcaccauccccgagagcauccuggagcugaccgacgcccuggcccugggcaugauggugcugaagaucgugagaaacauggagaaguaccagcuggccgugaccaucauggccauccugugcgugcccaacgccgugauccugcagaacgccuggaaggugagcugcaccacccuggccguggugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugagaugggaggagcaggccgagaucagcggcagcagccccauccugagcaucaccaucagcgaggacggcagcaugagcaucaagaacgaggaggaggagcagacccugaccauccugaucagaaccggccugcuggugaucagcggccuguuccccgugagcauccccaucaccgccgccgccugguaccugugggaggugaagaagcagagagccggcgugcugugggacgugcccagccccccccccgugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacaagggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucguggacaagaagggcaagguggugggccuguacggcaacggcguggugaccagaagcggcaccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccaucagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacaucaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagagugggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacagaguggccgccgagggcaucaacuacgccgacagaagauggugcuucgacggcgugaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccaagaacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggacuucggccugggcagcaucaccacccagcagcccgagagcaacauccuggacaucgaccugagacccgccagcgccuggacccuguacgccguggccaccaccuucaucacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaugaccgugaucgaccuggaccccauccccuacgaccccaaguucgagaagcagcugggccaggugaugcugcuggugcugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccgccaacaccagaagaggcaccggcaacaccggcgagacccugggcgagaaguggaagaacagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaaccuggugacccccgagggcaaggugguggaccugggcugcggcagaggcggcuggagcuacuacugcggcggccugaagaacgugaaggaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccguggaggccggcagaacccugagagugcugaaccugguggagaacuggcugaacaacaacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccagcggcaacaucgugagcagcgugaacaugaucagcagaaugcugaucaacagauucaccaugagacacaagaaggccaccuacgagcccgacguggaccugggcagcggcaccagaaacaucggcaucgagagcgagacccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacgugauccccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcggcuucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacauggagggcgagcacaagaagcuggccgaggccaucuucaagcugaccuaccagaacaagguggugagagugcagagacccacccccagaggcaccgugauggacaucaucagcagaagagaccagagaggcagcggccagguggugaccuacggccugaacaccuucaccaacauggaggcccagcugaucagacagauggagggcgagggcguguucaagagcauccagcagcugaccgugaaggaggagaucgccgugaagaacuggcugaucagagugggcagagagagacugagcagaauggccaucagcggcgacgacugcguggugaagccccuggacgacagauucgccagcgcccugaccgcccugaacgacaugggcaaggugagaaaggacauccagcagugggagcccagcagaggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugagagagaccgccugccugggcaagagcuacgcccagauguggagccugauguacuuccacagaagagaccugagacuggccgccaacgccaucugcagcgccgugcccagccacuggauccccaccagcagaaccaccuggagcauccacgccacccacgaguggaugaccaccgaggacaugcugaccguguggaacagaguguggauccaggagaaccccuggauggaggacaagacccccguggagagcugggaggagauccccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 17616 - RNA, 9876 nt, Artificial Sequence
  derived and/or modified CDS sequence (opt4) from DENV-2__JN851124__SS-prME
accgccggcaucaucaucaugaugauccccaccgugauggccuuccaccugaccaccagaaacggcgagccccacaugaucgugagcagacaggagaagggcaagagccugcuguucaagaccgagaacggcgugaacaugugcacccugauggccauggaccugggcgagcugugcgaggacaccaucaccuacaacugcccccugcugaagcagaacgagcccgaggacaucgacugcuggugcaacagcaccagcaccugggugaccuacggcaccugcaccgccaccggcgagcacagaagagagaagagaagcguggcccuggugccccacgugggcaugggccuggagaccagaaccgagaccuggaugagcagcgagggcgccuggaagcacgcccagagaaucgagaccugggugaugagacaccccggcuucaccgugauggccgccauccuggccuacaccaucggcaccaccuacuuccagagagugcugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcaccccgccacccugagaaaguacugcaucgaggccaagcugaccaacaccaccaccgccagcagaugccccacccagggcgagcccagccugaacgaggagcaggacaagagauucgugugcaagcacagcaugguggacagaggcuggggcaacggcugcggccuguucggcaagggcggcaucgugaccugcgccauguucaccugcaagaagaacauggagggcaagguggugcagcccgagaaccuggaguacaccaucgugaucaccccccacagcggcgaggagaacgccgugggcaacgacaccggcaagcacggcaaggagaucaaggugaccccccagagcagcaucaccgaggccgagcugaccggcuacggcaccgugaccauggagugcagccccagaaccggccuggacuucaacgagauggugcugcugcagauggagaacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucgugaucagagugcaguacgagggcgacggcagccccugcaagauccccuucgagaucauggaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugagcugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcguggugaucaccuggaucggcaugaacagcagaagcaccagccugagcgugagccuggugcuggugggcguggugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagaugaccaucaugaccggcgacaucaagggcaucaugcaggccggcaagagaagccugagaccccagcccaccgagcugaaguacagcuggaaggccuggggcaaggccaagaugcugagcaccgagcugcacaaccacaccuuccugaucgacggccccgagaccgccgagugccccaacaccaacagagccuggaacagccuggagguggaggacuacggcuucggcguguucaccaccaacaucuggcugaagcugaaggagagacaggacgugagcugcgacagcaagcugaugagcgccgccaucaaggacaacagagccgugcacgccgacaugggcuacuggaucgagagcgcccugaacgacaccuggaagaucgagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcagacuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugaugaccaccaucggcaucgugcugcugagccagagcaccauccccgagaccauccuggagcugaccgacgcccuggcccugggcaugauggugcugaagguggugagaaacauggagaaguaccagcuggccgugaccaucauggccauccugugcgugcccaacgccgugauccugcagaacgccuggaaggugagcugcaccacccuggccguggugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugagaugggaggagcaggccgagaucagcggcagcagccccauccugagcaucaccaucagcgaggacggcagcaugagcaucaagaacgaggaggaggagcagacccugaccauccugaucagaaccggccugcuggugaucagcggccuguuccccgugagcauccccaucaccgccgccgccugguaccugugggaggugaagaagcagagagccggcgugcugugggacgugcccagccccccccccgugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacaagggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucguggacaagaagggcaagguggugggccuguacggcaacggcguggugaccagaagcggcaccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccaucagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacaucaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagagugggcagaaaccccaagaacgagagcgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacagaguggccgccgagggcaucaacuacgccgacagaagauggugcuucgacggcgugaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagaaacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggacuucggccugggcagcagcaccacccagcagcacgagagcaacauccuggacaucgaccugagacccgccagcgccuggacccuguacgccguggccaccaccuucaucacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugagccugguggcccacuacgccaucaucggccccggccugcaggccaaggccaccagagaggcccagaagagagccgccgccggcaucaugaagaaccccaccguggacggcaucaccgugaucgaccuggaccccauccccuacgaccccaaguucgagaagcagcugggccaggugaugcugcuggugcugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccgccaacaccagaagaggcaccggcaacaccggcgagacccugggcgagaaguggaagaacagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaaccuggugacccccgagggcaaggugguggaccugggcugcggcagaggcggcuggagcuacuacugcggcggccugaagaacgugaaggaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccguggaggccggcagaacccugagagugcugaaccugguggagaacuggcugaacaacaacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccagcggcaacaucgugagcagcgugaacaugaucagcagaaugcugaucaacagauucaccaugagacacaagaaggugaccuacgagcccgacguggaccugggcagcggcaccagaaacaucggcaucgagagcgagacccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacgugauccccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcggcuucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacauggagggcgagcacaagaagcuggccgaggccaucuucaagcugaccuaccagaacaagguggugagagugcagagacccacccccagaggcaccgugauggacaucaucagcagaagagaccagagaggcagcggccagguggugaccuacggccugaacaccuucaccaacauggaggcccagcugaucagacagauggagggcgagggcguguucaagagcauccagcagcugaccgccaccgaggagaucgccgugaagaacuggcuggugagagugggcagagagagacugagcagaauggccaucagcggcgacgacugcguggugaagccccuggacgacagauucgccagcgcccugaccgcccugaacgacaugggcaaggugagaaaggacauccagcagugggagcccagcagaggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugagagagaccgccugccugggcaagagcuacgcccagauguggagccugauguacuuccacagaagagaccugagacuggccgccaacgccaucugcagcgccgugcccagccacugggugcccaccagcagaaccaccuggagcauccacgccacccacgaguggaugaccaccgaggacaugcugaccguguggaacagaguguggauccaggagaaccccuggauggaggacaagacccccguggagagcugggaggagauccccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 17617 - RNA, 9876 nt, Artificial Sequence
  derived and/or modified CDS sequence (opt4) from DENV-2__JN851114__SS-prME
accgccggcaucaucaucaugaugauccccaccgugauggccuuccaccugaccaccagaaacggcgagccccacaugaucgugagcagacaggagaagggcaagagccugcuguucaagaccgagaacggcgugaacaugugcacccugauggccauggaccugggcgagcugugcgaggacaccaucaccuacaacugcccccugcugagacagaacgagcccgaggacaucgacugcuggugcaacagcaccagcaccugggugaccuacggcaccugcaccgccaccggcgagcacagaagagagaagagaagcguggcccuggugccccacgugggcaugggccuggagaccagaaccgagaccuggaugagcagcgagggcgccuggaagcacgcccagagaaucgagaccuggauccugagacaccccggcuucaccaucauggccgccauccuggccuacaccaucggcaccaccuacuuccagagagugcugaucuucauccugcugaccgccgugacccccagcauggccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcaccccgccacccugagaaaguacugcguggaggccaagcugaccaacaccaccaccgccagcagaugccccacccagggcgagcccagccugaacgaggagcaggacaagagauucgugugcaagcacagcaugguggacagaggcuggggcaacggcugcggccuguucggcaagggcggcaucgugaccugcgccauguucaccugcaagaagaacauggagggcaagguggugcagcccgagaaccuggaguacaccaucgugaucaccccccacagcggcgaggagaacgccgugggcaacgacaccggcaagcacggcaaggagaucaaggugaccccccagagcagcaucaccgaggccgagcugaccggcuacggcaccgugaccauggagugcagccccagaaccggccuggacuucaacgagauggugcugcugcagauggagaacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucgugaucagagugcaguacgagggcgacggcagccccugcaagauccccuucgagaucauggaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugagcugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcguggugaucaccuggaucggcaugaacagcagaagcaccagccugagcgugagccuggugcuggugggcguggugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugaccgagaacgaggugaagcugaccaucaugaccggcgacaucaagggcaucaugcaggccggcaagagaagccugagaccccagcccaccgagcugaaguacagcuggaaggccuggggcaaggccaagaugcugagcaccgagcugcacaaccacaccuuccugaucgacggccccgagaccgccgagugccccaacaccaacagagccuggaacagccuggagguggaggacuacggcuucggcguguucaccaccaacaucuggcugaagcugaaggagagacaggacguguucugcgacagcaagcugaugagcgccgccaucaaggacaacagagccgugcacgccgacaugggcuacuggaucgagagcgcccugaacgacaccuggaagaucgagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcagacuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugaugaccaccaucggcaucgugcugcugagccagagcaccauccccgagagcauccuggagcugaccgacgcccuggcccugggcaugauggugcugaagaucgugagaaacauggagaaguaccagcuggccgugaccaucauggccauccugugcgugcccaacgccgugauccugcagaacgccuggaaggugagcugcaccacccuggccguggugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugagaugggaggagcaggccgagaucagcggcagcagccccauccugagcaucaccaucagcgaggacggcagcaugagcaucaagaacgaggaggaggagcagacccugaccauccugaucagaaccggccugcuggugaucagcggccuguuccccgugagcauccccaucaccgccgccgccugguaccugugggaggugaagaagcagagagccggcgugcugugggacgugcccagccccccccccguggagaaggccgagcuggaggacggcgccuacagaaucaagcagaagggcauccugggcuacagccagaucggcgccggcguguacaaggagggcaccuuccacaccauguggcacgugaccagaggcgccgugcugaugcacaagggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucguggacaagaagggcaagguggugggccuguacggcaacggcguggugaccagaagcggcaccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccaucagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacaucaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagagugggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacagaguggccgccgagggcaucaacuacgccgacagaagauggugcuucgacggcgugaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccaagaacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggacuucggccugggcagcaucaccacccagcagcccgagagcaacauccuggacaucgaccugagacccgccagcgccuggacccuguacgccguggccaccaccuucaucacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaugaccgugaucgaccuggaccccauccccuacgaccccaaguucgagaagcagcugggccaggugaugcugcuggugcugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccgccaacaccagaagaggcaccggcaacaccggcgagacccugggcgagaaguggaagaacagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaaccuggugacccccgagggcaaggugguggaccugggcugcggcagaggcggcuggagcuacuacugcggcggccugaagaacgugaaggaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccguggaggccggcagaacccugagagugcugaaccugguggagaacuggcugaacaacaacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccagcggcaacaucgugagcagcgugaacaugaucagcagaaugcugaucaacagauucaccaugagacacaagaaggccaccuacgagcccgacguggaccugggcagcggcaccagaaacaucggcaucgagagcgagacccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacgugauccccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcggcuucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacauggagggcgagcacaagaagcuggccgaggccaucuucaagcugaccuaccagaacaagguggugagagugcagagacccacccccagaggcaccgugauggacaucaucagcagaagagaccagagaggcagcggccagguggugaccuacggccugaacaccuucaccaacauggaggcccagcugaucagacagauggagggcgagggcguguucaagagcauccagcagcugaccgugaaggaggagaucgccgugaagaacuggcugaucagagugggcagagagagacugagcagaauggccaucagcggcgacgacugcguggugaagccccuggacgacagauucgccagcgcccugaccgcccugaacgacaugggcaaggugagaaaggacauccagcagugggagcccagcagaggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugagagagaccgccugccugggcaagagcuacgcccagauguggagccugauguacuuccacagaagagaccugagacuggccgccaacgccaucugcagcgccgugcccagccacugggugcccaccagcagaaccaccuggagcauccacgccacccacgaguggaugaccaccgaggacaugcugaccguguggaacagaguguggauccaggagaaccccuggauggaggacaagacccccguggagagcugggaggagauccccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 17618 - RNA, 9876 nt, Artificial Sequence
  derived and/or modified CDS sequence (opt4) from DENV-2__JN851126__SS-prME
accgccggcaucaucaucaugaugauccccaccgugauggccuuccaccugaccaccagaaacggcgagccccacaugaucgugagcagacaggagaagggcaagagccugcuguucaagaccgagaacggcgugaacaugugcacccugauggccauggaccugggcgagcugugcgaggacaccaucaccuacaacugcccccugcugaagcagaacgagcccgaggacaucgacugcuggugcaacagcaccagcaccugggugaccuacggcaccugcaccgccaccggcgagcacagaagagagaagagaagcguggcccuggugccccacgugggcaugggccuggagaccagaaccgagaccuggaugagcagcgagggcgccuggaagcacgcccagagaaucgagaccugggugcugagacaccccggcuucaccaucauggccgccauccuggccuacaccaucggcaccaccuacuuccagagagugcugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcaccccgccacccugagaaaguacugcaucgaggccaagcugaccaacaccaccaccgccagcagaugccccacccagggcgagcccagccugaacgaggagcaggacaagagauucgugugcaagcacagcaugguggacagaggcuggggcaacggcugcggccuguucggcaagggcggcaucgugaccugcgccauguucaccugcaagaagaacauggagggcaagaucgugcagcccgagaaccuggaguacaccaucgugaucaccccccacagcggcgaggagaacgccgugggcaacgacaccggcaagcacggcaaggagaucaaggugaccccccagagcagcaucaccgaggccgagcugaccggcuacggcaccgugaccauggagugcagccccagaaccggccuggacuucaacgagauggugcugcugcagauggagaacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucgugaucagagugcaguacgagggcgacggcagccccugcaagauccccuucgagaucauggaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugagcugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcguggugaucaccuggaucggcaugaacagcagaagcaccagccugagcgugagccuggugcuggugggcguggugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgagaucaagcugaccaucaugaccggcgacaucaagggcaucaugcaggccggcaagagaagccugagaccccagcccaccgagcugaaguacagcuggaaggccuggggcaaggccaagaugcugagcaccgagcugcacaaccacaccuuccugaucgacggccccgagaccgccgagugccccaacaccaacagagccuggaacagccuggagguggaggacuacggcuucggcguguucaccaccaacaucuggcugaagcugaaggagagacaggacguguucugcgacagcaagcugaugagcgccgccaucaaggacaacagagccgugcacgccgacaugggcuacuggaucgagagcgcccugaacgacaccuggaagaucgagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcagacuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacaccauccugcugguggccgugagcuucgugacccugaucaccggcaacaugagcuucagagaccugggcagagugguggugauggugggcgccaccaugaccgacgacaucggcaugggcgugaccuaccuggcccugcuggccgccuucaaggugagacccaccuucgccgccggccugcugcugagaaagcugaccagcaaggagcugaugaugaccaccaucggcaucgugcugcugagccagagcaccauccccgagaccauccuggagcugaccgacgcccuggcccugggcaugauggugcugaagaucgugagaaacauggagaaguaccagcuggccgugaccaucauggccauccugugcgugcccaacgccgugauccugcagaacgccuggaaggugagcugcaccgcccuggccguggugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugagaugggaggagcaggccgagaucagcggcagcagccccauccugagcaucaccaucagcgaggacggcagcaugagcaucaagaacgaggaggaggagcagacccugaccauccugaucagaaccggccugcuggugaucagcggccuguuccccgugagcauccccaucaccgccgccgccugguaccugugggaggugaagaagcagagagccggcgugcugugggacgugcccagccccccccccgugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacaagggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucguggacaagaagggcaagguggugggccuguacggcaacggcguggugaccagaagcggcaccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccaucagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagaaggagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacaucaagaccagaaccaacgacugggacuucguggugaccaccgacaucagcgagaugggcgccaacuucaaggccgagagagugaucgaccccagaagaugcgugaagcccgugauccugaccgacggcgaggagagagugauccuggccggccccaugcccgugacccacagcagcgccgcccagagaagaggcagagugggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacagaguggccgccgagggcaucaacuacgccgacagaagauggugcuucgacggcgugaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagaaacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggacuucggccugggcagcaucaccacccagcagcccgagagcaacauccuggacaucgaccugagacccgccagcgccuggacccuguacgccguggccaccaccuucaucacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggaccccauccccuacgaccccaaguucgagaagcagcugggccaggugaugcugcuggugcugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccgccaacaccagaagaggcaccggcaacaccggcgagacccugggcgagaaguggaagaacagacugaacgcccugggcaagagcgaguuccagaccuacaagaagagcggcauccaggagguggacagaacccuggccaaggagggcaucaagagaggcgagaccgaccaccacgccgugagcagaggcagcgccaagcugagaugguucguggagagaaaccuggugacccccgagggcaaggugguggaccugggcugcggcagaggcggcuggagcuacuacugcggcggccugaagaacgugaaggaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccguggaggccggcagaacccugagagugcugaaccugguggagaacuggcugaacaacaacacccaguucugcaucaaggugcugaaccccuacaugcccagcgugaucgagaagauggagacccugcagagaaagcacggcggcgcccuggugagaaacccccugagcagaaacagcacccacgagauguacugggugagcaacgccagcggcaacaucgugagcagcgugaacaugaucagcagaaugcugaucaacagauucaccaugagacacaagaaggccaccuacgagcccgacguggaccugggcagcggcaccagaaacaucggcaucgagagcgagacccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacgugauccccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcagauucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacauggagggcgagcacaagaagcuggccgaggccaucuucagacugaccuaccagaacaagguggugagagugcagagacccacccccagaggcaccgugauggacaucaucagcagaagagaccagagaggcagcggccagguggugaccuacggccugaacaccuucaccaacauggaggcccagcugaucagacagauggagggcgagggcguguucaagagcauccagcaccugaccgugaccgaggagaucgccgugaagaacuggcuggugagagugggcagagagagacugagcagaauggccaucagcggcgacgacugcguggugaagccccuggacgacagauucgccagcgcccugaccgcccugaacgacaugggcaaggugagaaaggacauccagcagugggagcccagcagaggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugagagagaccgccugccugggcaagagcuacgcccagauguggagccugauguacuuccacagaagagaccugagacuggccgccaacgccaucugcagcgccgugcccagccacugggugcccaccagcagaaccaccuggagcauccacgccacccacgaguggaugaccaccgaggacaugcugaccguguggaacagaguguggauccaggagaaccccuggauggaggacaagacccccguggagagcugggaggagauccccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 17619 - RNA, 9876 nt, Artificial Sequence
  derived and/or modified CDS sequence (opt4) from DENV-2__JN851121__SS-prME
accgccggcaucaucaucaugaugauccccaccgugauggccuuccaccugaccaccagaaacggcgagccccacaugaucgugagcagacaggagaagggcaagagccugcuguucaagaccgagaacggcgugaacaugugcacccugauggccauggaccugggcgagcugugcgaggacaccaucaccuacaacugcccccugcugagacagaacgagcccgaggacaucgacugcuggugcaacagcaccagcaccugggugaccuacggcaccugcaccgccaccggcgagcacagaagagagaagagaagcguggcccuggugccccacgugggcaugggccuggagaccagaaccgagaccuggaugagcagcgagggcgccuggaagcacgcccagagaaucgagaccuggauccugagacaccccggcuucaccaucauggccgccauccuggccuacaccaucggcaccaccuacuuccagagagugcugaucuucauccugcugaccgccgugacccccagcauggccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcaccccgccacccugagaaaguacugcguggaggccaagcugaccaacaccaccaccgccagcagaugccccacccagggcgagcccagccugaacgaggagcaggacaagagauucgugugcaagcacagcaugguggacagaggcuggggcaacggcugcggccuguucggcaagggcggcaucgugaccugcgccauguucaccugcaagaagaacauggagggcaagguggugcagcccgagaaccuggaguacaccaucgugaucaccccccacagcggcgaggagaacgccgugggcaacgacaccggcaagcacggcaaggagaucaaggugaccccccagagcagcaucaccgaggccgagcugaccggcuacggcaccgugaccauggagugcagccccagaaccggccuggacuucaacgagauggugcugcugcagauggagaacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucgugaucagagugcaguacgagggcgacggcagccccugcaagauccccuucgagaucauggaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugagcugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcguggugaucaccuggaucggcaugaacagcagaagcaccagccugagcgugagccuggugcuggugggcguggugacccuguaccugggcgccauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugaccgagaacgaggugaagcugaccaucaugaccggcgacaucaagggcaucaugcaggccggcaagagaagccugagaccccagcccaccgagcugaaguacagcuggaaggccuggggcaaggccaagaugcugagcaccgagcugcacaaccacaccuuccugaucgacggccccgagaccgccgagugccccaacaccaacagagccuggaacagccuggagguggaggacuacggcuucggcguguucaccaccaacaucuggcugaagcugaaggagagacaggacguguucugcgacagcaagcugaugagcgccgccaucaaggacaacagagccgugcacgccgacaugggcuacuggaucgagagcgcccugaacgacaccuggaagaucgagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcagacuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugaugaccaccaucggcaucgugcugcugagccagagcaccauccccgagagcauccuggagcugaccgacgcccuggcccugggcaugauggugcugaagaucgugagaaacauggagaaguaccagcuggccgugaccaucauggccauccugugcgugcccaacgccgugauccugcagaacgccuggaaggugagcugcaccacccuggccguggugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugagaugggaggagcaggccgagaucagcggcagcagccccauccugagcaucaccaucagcgaggacggcagcaugagcaucaagaacgaggaggaggagcagacccugaccauccugaucagaaccggccugcuggugaucagcggccuguuccccgugagcauccccaucaccgccgccgccugguaccugugggaggugaagaagcagagagccggcgugcugugggacgugcccagccccccccccgugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacaagggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucguggacaagaagggcaagguggugggccuguacggcaacggcguggugaccagaagcggcaccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccaucagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacaucaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagagugggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacagaguggccgccgagggcaucaacuacgccgacagaagauggugcuucgacggcgugaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccaagaacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggacuucggccugggcagcaucaccaaccagcagcccgagagcaacauccuggacaucgaccugagacccgccagcgccuggacccuguacgccguggccaccaccuucaucacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaugaccgugaucgaccuggaccccauccccuacgaccccaaguucgagaagcagcugggccaggugaugcugcuggugcugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccgccaacaccagaagaggcaccggcaacaccggcgagacccugggcgagaaguggaagaacagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaaccuggugacccccgagggcaaggugguggaccugggcugcggcagaggcggcuggagcuacuacugcggcggccugaagaacgugaaggaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccguggaggccggcagaacccugagagugcugaaccugguggagaacuggcugaacaacaacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccagcggcaacaucgugagcagcgugaacaugaucagcagaaugcugaucaacagauucaccaugagacacaagaaggccaccuacgagcccgacguggaccugggcagcggcaccagaaacaucggcaucgagagcgagacccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacgugauccccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcggcuucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacauggagggcgagcacaagaagcuggccgaggccaucuucaagcugaccuaccagaacaagguggugagagugcagagacccacccccagaggcaccgugauggacaucaucagcagaagagaccagagaggcagcggccagguggugaccuacggccugaacaccuucaccaacauggaggcccagcugaucagacagauggagggcgagggcguguucaagagcauccagcagcugaccgugaaggaggagaucgccgugaagaacuggcugaucagagugggcagagagagacugagcagaauggccaucagcggcgacgacugcguggugaagccccuggacgacagauucgccagcgcccugaccgcccugaacgacaugggcaaggugagaaaggacauccagcagugggagcccagcagaggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugagagagaccgccugccugggcaagagcuacgcccagauguggagccugauguacuuccacagaagagaccugagacuggccgccaacgccaucugcagcgccgugcccagccacugggugcccaccagcagaaccaccuggagcauccacgccacccacgaguggaugaccaccgaggacaugcugaccguguggaacagaguguggauccaggagaaccccuggauggaggacaagacccccguggagagcugggaggagauccccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 17620 - RNA, 9876 nt, Artificial Sequence
  derived and/or modified CDS sequence (opt4) from DENV-2__JN851115__SS-prME
accgccggcaucaucaucaugaugauccccaccgugauggccuuccaccugaccaccagaaacggcgagccccacaugaucgugagcagacaggagaagggcaagagccugcuguucaagaccgagaacggcgugaacaugugcacccugauggccauggaccugggcgagcugugcgaggacaccaucaccuacaacugcccccugcugagacagaacgagcccgaggacaucgacugcuggugcaacagcaccagcaccugggugaccuacggcaccugcaccgccaccggcgagcacagaagagagaagagaagcguggcccuggugccccacgugggcaugggccuggagaccagaaccgagaccuggaugagcagcgagggcgccuggaagcacgcccagagaaucgagaccuggauccugagacaccccggcuucaccaucauggccgccauccuggccuacaccaucggcaccaccuacuuccagagagugcugaucuucauccugcugaccgccgugacccccagcauggccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcaccccgccacccugagaaaguacugcguggaggccaagcugaccaacaccaccaccgccagcagaugccccacccagggcgagcccagccugaacgaggagcaggacaagagauucgugugcaagcacagcaugguggacagaggcuggggcaacggcugcggccuguucggcaagggcggcaucgugaccugcgccauguucaccugcaagaagaacauggagggcaagguggugcagcccgagaaccuggaguacaccaucgugaucaccccccacagcggcgaggagaacgccgugggcaacgacaccggcaagcacggcaaggagaucaaggugaccccccagagcagcaucaccgaggccgagcugaccggcuacggcaccgugaccauggagugcagccccagaaccggccuggacuucaacgagauggugcugcugcagauggagaacaaggccuggcuggugcacagacaguggcugcuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucgugaucagagugcaguacgagggcgacggcagccccugcaagauccccuucgagaucauggaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugagcugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcguggugaucaccuggaucggcaugaacagcagaagcaccagccugagcgugagccuggugcuggugggcguggugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugaccgagaacgaggugaagcugaccaucaugaccggcgacaucaagggcaucaugcaggccggcaagagaagccugagaccccagcccaccgagcugaaguacagcuggaaggccuggggcaaggccaagaugcugagcaccgagcugcacaaccacaccuuccugaucgacggccccgagaccgccgagugccccaacaccaacagagccuggaacagccuggagguggaggacuacggcuucggcguguucaccaccaacaucuggcugaagcugaaggagagacaggacguguucugcgacagcaagcugaugagcgccgccaucaaggacaacagagccgugcacgccgacaugggcuacuggaucgagagcgcccugaacgacaccuggaagaucgagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcagacuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugaugaccaccaucggcaucgugcugcugagccagagcaccauccccgagagcauccuggagcugaccgacgcccuggcccugggcaugauggugcugaagaucgugagaaacauggagaaguaccagcuggccgugaccaucauggccauccugugcgugcccaacgccgugauccugcagagcgccuggaaggugagcugcaccacccuggccguggugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugagaugggaggagcaggccgagaucagcggcagcagccccauccugagcaucaccaucagcgaggacggcagcaugagcaucaagaacgaggaggaggagcagacccugaccauccugaucagaaccggccugcuggugaucagcggccuguuccccgugagcauccccaucaccgccgccgccugguaccugugggaggugaagaagcagagagccggcgugcugugggacgugcccagccccccccccgugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacaagggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucguggacaagaagggcaagguggugggccuguacggcaacggcguggugaccagaagcggcaccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccaucagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacaucaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagagugggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacagaguggccgccgagggcaucaacuacgccgacagaagauggugcuucgacggcgugaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccaagaacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggacuucggccugggcagcaucaccacccagcagcccgagagcaacauccuggacaucgaccugagacccgccagcgccuggacccuguacgccguggccaccaccuucaucacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaugaccgugaucgaccuggaccccauccccuacgaccccaaguucgagaagcagcugggccaggugaugcugcuggugcugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccgccaacaccagaagaggcaccggcaacaccggcgagacccugggcgagaaguggaagaacagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaaccuggugacccccgagggcaaggugguggaccugggcugcggcagaggcggcuggagcuacuacugcggcggccugaagaacgugaaggaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccguggaggccggcagaacccugagagugcugaaccugguggagaacuggcugaacaacaacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccagcggcaacaucgugagcagcgugaacaugaucagcagaaugcugaucaacagauucaccaugagacacaagaaggccaccuacgagcccgacguggaccugggcagcggcaccagaaacaucggcaucgagagcgagacccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacgugauccccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcggcuucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacauggagggcgagcacaagaagcuggccgaggccaucuucaagcugaccuaccagaacaagguggugagagugcagagacccacccccagaggcaccgugauggacaucaucagcagaagagaccagagaggcagcggccagguggugaccuacggccugaacaccuucaccaacauggaggcccagcugaucagacagauggagggcgagggcguguucaagagcauccagcagcugaccgugaaggaggagaucgccgugaagaacuggcugaucagagugggcagagagagacugagcagaauggccaucagcggcgacgacugcguggugaagccccuggacgacagauucgccagcgcccugaccgcccugaacgacaugggcaaggugagaaaggacauccagcagugggagcccagcagaggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugagagagaccgccugccugggcaagagcuacgcccagauguggagccugauguacuuccacagaagagaccugagacuggccgccaacgccaucugcagcgccgugcccagccacugggugcccaccagcagaaccaccuggagcauccacgccacccacgaguggaugaccaccgaggacaugcugaccguguggaacagaguguggauccaggagaaccccuggauggaggacaagacccccguggagagcugggaggagauccccuaccugggcaagagagaggaccaguggugcggcagccugaucggccugaccagcagagccaccugggccaagaacauccagaccgccaucaaccaggugagaagccugaucggcuacgaggaguacaccgacuacaugcccagcaugaagagauucagaagagaggaggaggaggccggcgugcugugguga

SEQ ID NO: 17621 - RNA, 9876 nt, Artificial Sequence
  derived and/or modified CDS sequence (opt4) from DENV-2__JN851127__SS-prME
accgccggcaucaucaucaugaugauccccaccgugauggccuuccaccugaccaccagaaacggcgagccccacaugaucgugagcagacaggagaagggcaagagccugcuguucaagaccgagaacggcgugaacaugugcacccugauggccauggaccugggcgagcugugcgaggacaccaucaccuacaacugcccccugcugaagcagaacgagcccgaggacaucgacugcuggugcaacagcaccagcaccugggugaccuacggcaccugcaccgccaccggcgagcacagaagagagaagagaagcguggcccuggugccccacgugggcaugggccuggagaccagaaccgagaccuggaugagcagcgagggcgccuggaagcacgcccagagaaucgagaccugggugcugagacaccccggcuucaccaucauggccgccauccuggccuacaccaucggcaccaccuacuuccagagagugcugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcaccccgccacccugagaaaguacugcaucgaggccaagcugaccaacaccaccaccgccagcagaugccccacccagggcgagcccagccugagcgaggagcaggacaagagauucgugugcaagcacagcaugguggacagaggcuggggcaacggcugcggccuguucggcaagggcggcaucgugaccugcgccauguucaccugcaagaagaacauggagggcaagaucgugcagcccgagaaccuggaguacaccaucgugaucaccccccacagcggcgaggagaacgccgugggcaacgacaccggcaagcacggcaaggagaucaaggugaccccccagagcagcaucaccgaggccgagcugaccggcuacggcaccgugaccauggagugcagccccagaaccggccuggacuucaacgagauggugcugcugcagauggagaacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucgugaucagagugcaguacgagggcgacggcagccccugcaagauccccuucgagaucauggaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugagcugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcguggugaucaccuggaucggcaugaacagcagaagcaccagccugagcgugagccuggugcuggugggcguggugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgagaucaagcugaccaucaugaccggcgacaucaagggcaucaugcaggccggcaagagaagccugagaccccagcccaucgagcugaaguacagcuggaaggccuggggcaaggccaagaugcugagcaccgagcugcacaaccacaccuuccugaucgacggccccgagaccgccgagugccccaacaccaacagagccuggaacagccuggagguggaggacuacggcuucggcguguucaccaccaacaucuggcugaagcugaaggagagacaggacguguucugcgacagcaagcugaugagcgccgugaucaaggacaacagagccgugcacgccgacaugggcuacuggaucgagagcgcccugaacgacaccuggaagaucgagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcagacuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugaugaccaccaucggcaucgugcugcugagccagagcaccauccccgagaccauccuggagcugaccgacgcccuggcccugggcaugauggugcugaagaucgugagaaacauggagaaguaccagcuggccgugaccaucauggccauccugugcgugcccaacgccgugauccugcagaacgccuggaaggugagcugcaccacccuggccguggugagcgugagcccccugcugcugaccagcagcagacagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugagaugggaggagcaggccgagaucagcggcagcagccccauccugagcaucaccaucagcgaggacggcagcaugagcaucaagaacgaggaggaggagcagacccugaccauccugaucagaaccggccugcuggugaucagcggccuguuccccgugagcauccccaucaccgccgccgccugguaccugugggaggugaagaagcagagagccggcgugcugugggacgugcccagccccccccccgugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacaagggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucguggacaagaagggcaagguggugggccuguacggcaacggcguggugaccagaagcggcaccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccaucagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacaucaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagagugggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacagaguggccgccgagggcaucaacuacgccgacagaagauggugcuucgacggcgugaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagaaacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggacuucggccugggcagcaucaccacccagcagcccgagagcaacauccuggacaucgaccugagacccgccagcgccuggacccuguacgccguggccaccaccuucaucacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggaccccauccccuacgaccccaaguucgagaagcagcugggccaggugaugcugcuggugcugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccgccaacaccagaagaggcaccggcaacaccggcgagacccugggcgagaaguggaagaacagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucaucgagagaaaccuggugacccccgagggcaaggugguggaccugggcugcggcagaggcggcuggagcuacuacugcggcggccugaagaacgugaaggaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccguggaggccggcagaacccugagagugcugaaccugguggagaacuggcugaacaacaacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccagcggcaacaucgugagcagcgugaacaugaucagcagaaugcugaucaacagauucaccaugagacacaagaaggccaccuacgagcccgacguggaccugggcagcggcaccagaaacaucggcaucgagagcgagacccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacgugauccccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagagaaagacccccagaaugugcaccagagaggaguucaccagaaaggugagaagcaacgccgcccugggcgccaucuucaccgacgagaacaaguggaagagcgccagagaggccguggaggacagcggcuucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacauggagggcgugcacaagaagcuggccgaggccaucuucagacugaccuaccagaacaagguggugagagugcagagacccacccccagaggcaccgugauggacaucaucagcagaagagaccagagaggcagcggccagguggugaccuacggccugaacaccuucaccaacauggaggcccagcugaucagacagauggagggcgagggcguguucaagagcauccagcaccugaccgugaccgaggagaucgccgugaagaacuggcuggugagagugggcagagagagacugagcagaauggccaucagcggcgacgacugcguggugaagccccuggacgacagauucgccagcgcccugaccgcccugaacgacaugggcaaggugagaaaggacauccagcagugggagcccagcagaggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugagagagaccgccugccugggcaagagcuacgcccagauguggagccugauguacuuccacagaagagaccugagacuggccgccaacgccaucugcagcgccgugcccagccacugggugcccaccagcagaaccaccuggagcauccacgccacccacgaguggaugaccaccgaggacaugcugaccguguggaacagaguguggauccaggagaaccccuggauggaggacaagacccccaucgagagcugggaggagauccccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 17622 - RNA, 9876 nt, Artificial Sequence
  derived and/or modified CDS sequence (opt4) from DENV-2__JN851120__SS-prME
accgccggcaucaucaucaugaugauccccaccgugauggccuuccaccugaccaccagaaacggcgagccccacaugaucgugagcagacaggagaagggcaagagccugcuguucaagaccgagaacggcgugaacaugugcacccugauggccauggaccugggcgagcugugcgaggacaccaucaccuacaacugcccccugcugagacagaacgagcccgaggacaucgacugcuggugcaacagcaccagcaccugggugaccuacggcaccugcaccgccaccggcgagcacagaagagagaagagaagcguggcccuggugccccacgugggcaugggccuggagaccagaaccgagaccuggaugagcagcgagggcgccuggaagcacgcccagagaaucgagaccuggauccugagacaccccggcuucaccaucauggccgccauccuggccuacaccgugggcaccaccuacuuccagagagugcugaucuucauccugcugaccgccgugacccccagcauggccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcaccccgccacccugagaaaguacugcguggaggccaagcugaccaacaccaccaccgccagcagaugccccacccagggcgagcccagccugaacgaggagcaggacaagagauucgugugcaagcacagcaugguggacagaggcuggggcaacggcugcggccuguucggcaagggcggcaucgugaccugcgccauguucaccugcaagaagaacauggagggcaagguggugcagcccgagaaccuggaguacaccaucgugaucaccccccacagcggcgaggagaacgccgugggcaacgacaccggcaagcacggcaaggagaucaaggugaccccccagagcagcaucaccgaggccgagcugaccggcuacggcaccgugaccauggagugcagccccagaaccggccuggacuucaacgagauggugcugcugcagauggagaacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucgugaucagagugcaguacgagggcgacggcagccccugcaagauccccuucgagaucauggaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugagcugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcguggugaucaccuggaucggcaugaacagcagaagcaccagccugagcgugagccuggugcuggugggcguggugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugaccgagaacgaggugaagcugaccaucaugaccggcgacaucaagggcaucaugcaggccggcaagagaagccugagaccccagcccaccgagcugaaguacagcuggaaggccuggggcaaggccaagaugcugagcaccgagcugcacaaccacaccuuccugaucgacggccccgagaccgccgagugccccaacaccaacagagccuggaacagccuggagguggaggacuacggcuucggcguguucaccaccaacaucuggcugaagcugaaggagagacaggacguguucugcgacagcaagcugaugagcgccgccaucaaggacaacagagccgugcacgccgacaugggcuacuggaucgagagcgcccugaacgacaccuggaagaucgagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcagacuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugaugaccaccaucggcaucgugcugcugagccagagcaccauccccgagagcauccuggagcugaccgacgcccuggcccugggcaugauggugcugaagaucgugagaaacauggagaaguaccagcuggccgugaccaucauggccauccugugcgugcccaacgccgugauccugcagaacgccuggaaggugagcugcaccacccuggccguggugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugagaugggaggagcaggccgagaucagcggcagcagccccauccugagcaucaccaucagcgaggacggcagcaugagcaucaagaacgaggaggaggagcagacccugaccauccugaucagaaccggccugcuggugaucagcggccuguuccccgugagcauccccaucaccgccgccgccugguaccugugggaggugaagaagcagagagccggcgugcugugggacgugcccagccccccccccgugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacaagggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucguggacaagaagggcaagguggugggccuguacggcaacggcguggugaccagaagcggcaccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccaucagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacaucaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagagugggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacagaguggccgccgagggcaucaacuacgccgacagaagauggugcuucgacggcgugaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccaagaacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggacuucggccugggcagcaucaccacccagcagcccgagagcaacauccuggacaucgaccugagacccgccagcgccuggacccuguacgccguggccaccaccuucaucacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaugaccgugaucgaccuggaccccauccccuacgaccccaaguucgagaagcagcugggccaggugaugcugcuggugcugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccgccaacaccagaagaggcaccggcaacaccggcgagacccugggcgagaaguggaagaacagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaaccuggugacccccgagggcaaggugguggaccugggcugcggcagaggcggcuggagcuacuacugcggcggccugaagaacgugaaggaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccguggaggccggcagaacccugagagugcugaaccugguggagaacuggcugaacaacaacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccagcggcaacaucgugagcagcgugaacaugaucagcagaaugcugaucaacagauucaccaugagacacaagaaggccaccuacgagcccgacguggaccugggcagcggcaccagaaacaucggcaucgagagcgagacccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacgugauccccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcggcuucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacauggagggcgagcacaagaagcuggccgaggccaucuucaagcugaccuaccagaacaagguggugagagugcagagacccacccccagaggcaccgugauggacaucaucagcagaagagaccagagaggcagcggccagguggugaccuacggccugaacaccuucaccaacauggaggcccagcugaucagacagauggagggcgagggcguguucaagagcauccagcagcugaccgugaaggaggagaucgccgugaagaacuggcugaucagagugggcagagagagacugagcagaauggccaucagcggcgacgacugcguggugaagccccuggacgacagauucgccagcgcccugaccgcccugaacgacaugggcaaggugagaaaggacauccagcagugggagcccagcagaggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugagagagaccgccugccugggcaagagcuacgcccagauguggagccugauguacuuccacagaagagaccugagacuggccgccaacgccaucugcagcgccgugcccagccacugggugcccaccagcagaaccaccuggagcauccacgccacccacgaguggaugaccaccgaggacaugcugaccguguggaacagaguguggauccaggagaaccccuggauggaggacaagacccccguggagagcugggaggagauccccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaaucgaggaggaggaggccggcgugcugugguga

SEQ ID NO: 17623 - RNA, 9876 nt, Artificial Sequence
  derived and/or modified CDS sequence (opt4) from DENV-2__JN851131__SS-prME
accgccggcgugaucaucaugaugauccccaccgugauggccuuccaccugaccaccagaaacggcgagccccacaugaucgugagcagacaggagaagggcaagagccugcuguucaagaccgagaacggcgugaacaugugcacccugauggccaucgaccugggcgagcugugcgaggacaccaucaccuacaacugcccccugcugagacagaacgagcccgaggacaucgacugcuggugcaacagcaccagcaccugggugaccuacggcaccugcaccgccaccggcgagcacagaagagagaagagaagcguggcccuggugccccacgugggcaugggccuggagaccagaaccgagaccuggaugagcagcgagggcgccuggaagcacgcccagagaaucgagaccugggugcugagacaccccggcuucaccaucauggccgccauccuggccuacaccaucggcaccaccuacuuccagagagugcugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcaccccgccacccugagaaaguacugcaucgaggccaagcugaccaacaccaccaccgccagcagaugccccacccagggcgagcccagccugaaggaggagcaggacaagagauucgugugcaagcacagcaugguggacagaggcuggggcaacggcugcggccuguucggcaagggcggcaucgugaccugcgccauguucaccugcaagaagaacauggagggcaagguggugcagcccgagaaccuggaguacaccaucgugaucaccccccacagcggcgaggagaacgccgugggcaacgacaccggcaagcacggcaaggagaucaaggugaccccccagagcagcaucaccgaggccgagcugaccggcuacggcaccgugaccauggagugcagccccagaaccggccuggacuucaacgagauggugcugcugcagauggaggacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucgugaucagagugcaguacgagggcgacggcagccccugcaagauccccuucgagaucauggaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugagcugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcguggugaucaccuggaucggcaugaacagcagaagcaccagccugagcgugagccuggugcuggugggcguggugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagcugcacaaccacaccuuccugaucgacggccccgagaccgccgagugccccaacaccaacagagccuggaacagccuggagguggaggacuacggcuucggcguguucaccaccaacaucuggcugaagcugaaggagagacaggagguguucugcgacagcaagcugaugagcgccgccaucaaggacaacagagccgugcacgccgacaugggcuacuggaucgagagcgcccugaacgacaccuggaagaucgagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcaagcuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagacccagcaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugaugaccaccaucggcaucgugcugcugagccagagcaccauccccgagaccauccuggagcugaccgacgcccuggcccugggcaugauggugcugaagaucgugagaaacauggagaaguaccagcuggccgugaccaucauggccauccugugcgugcccaacgccgugauccugcagaacgccuggaaggugagcugcaccacccuggccguggugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugagaugggaggagcaggccgagaucagcggcagcagccccauccugagcaucaccaucagcgaggacggcagcaugagcaucaagaacgaggaggaggagcagacccugaccauccugaucagaaccggccugcuggugaucagcggccuguuccccgugagcauccccaucaccgccgccgccugguaccugugggaggugaagaagcagagagccggcgugcugugggacgugcccagccccccccccgugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacaagggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucguggacaagaagggcaagguggugggccuguacggcaacggcguggugaccagaagcggcaccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagaguggagcacaccggcagagagaucguggaccugaugugccacgccaccuucaccaugagacugcugagccccaucagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgaguggaucaccgacuucaagggcaagaccgugugguucgugcccagcaucaaggccggcaacgacaucgccgccugccugagaaagaacggcaagaaggugauccagcugagcagaaagaccuucgacagcgaguacaucaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagagugggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacagaguggccgccgagggcaucaacuacgccgacagaagauggugcuucgacggcgugaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagaaacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcgugcugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggacuucggccugggcagcaucgccauccagcagcccgagagcaacauccuggacaucgaccugagacccgccagcgccuggacccuguacgccguggccaccaccuucaucacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggaccccauccccuacgaccccaaguucgagaagcagcugggccaggugaugcugcuggugcugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccgccaacaccagaagaggcaccggcaacaccggcgagacccugggcgagaaguggaagaacagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaaccuggugacccccgagggcaaggugguggaccugggcugcggcagaggcggcuggagcuacuacugcggcggccugaagaacgugaaggaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccguggaggccggcagaacccugagagugcugaaccugguggagaacuggcugaacaacaacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccagcggcaacaucgugagcagcgugaacaugaucagcagaaugcugaucaacagauucaccaugagacacaagaaggccaccuacgagcccgacguggaccugggcagcggcaccagaaacaucggcaucgagagcgagaagcccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacgugauccccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcggcuucugggagcuggugaacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacauggagggcgagcacaagaagcuggccgaggccaucuucaagcugaccuaccagaacaagguggugagagugcagagacccacccccagaggcaccgugauggacaucaucagcagaagagaccagagaggcagcggccagguggugaccuacggccugaacaccuucaccaacauggaggcccagcugaucagacagauggagggcgagggcguguucaagagcauccagcaccugaccgugaccgaggagaucgccgugaagaacuggcuggugagagugggcagagagagacugagcagaauggccaucagcggcgacgacugcguggugaagccccuggacgacagauucgccagcgcccugaccgcccugaacgacaugggcaaggugagaaaggacauccagcagugggagcccagcagaggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugagagagaccgccugccugggcaagagcuacgcccagauguggagccugauguacuuccacagaagagaccugagacuggccgccaacgccaucugcagcgccgugcccagccacugggugcccaccagcagaaccaccuggagcauccacgccacccacgaguggaugaccaccgaggacaugcugaccguguggaacagaguguggauccaggagaaccccuggauggaggacaagacccccguggagagcugggaggagauccccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 17624 - RNA, 9876 nt, Artificial Sequence
  derived and/or modified CDS sequence (opt4) from DENV-2__JN851122__SS-prME
accgccggcaucaucaucaugaugauccccaccgugauggccuuccaccugaccaccagaaacggcgagccccacaugaucgugagcagacaggagaagggcaagagccugcuguucaagaccgagaacggcgugaacaugugcacccugauggccauggaccugggcgagcugugcgaggacaccaucaccuacaacugcccccugcugagacagaacgagcccgaggacaucgacugcuggugcaacagcaccagcaccugggugaccuacggcaccugcaccgccaccggcgagcacagaagagagaagagaagcguggcccuggugccccacgugggcaugggccuggagaccagaaccgagaccuggaugagcagcgagggcgccuggaagcacgcccagagaaucgagaccuggauccugagacaccccggcuucaccaucauggccgccauccuggccuacaccaucggcaccaccuacuuccagagagugcugaucuucauccugcugaccgccgugacccccagcauggccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcaccccgccacccugagaaaguacugcguggaggccaagcugaccaacaccaccaccgccagcagaugccccacccagggcgagcccagccugaacgaggagcaggacaagagauucgugugcaagcacagcaugguggacagaggcuggggcaacggcugcggccuguucggcaagggcggcaucgugaccugcgccauguucaccugcaagaagaacauggagggcaagguggugcagcccgagaaccuggaguacaccaucgugaucaccccccacagcggcgaggagaacgccgugggcaacgacaccggcaagcacggcaaggagaucaaggugaccccccagagcagcaucaccgaggccgagcugaccggcuacggcaccgugaccauggagugcagccccagaaccggccuggacuucaacgagauggugcugcugcagauggagaacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucgugaucagagugcaguacgagggcgacggcagccccugcaagauccccuucgagaucauggaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugagcugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcguggugaucaccuggaucggcaugaacagcagaagcaccagccugagcgugagccuggugcuggugggcguggugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugaccgagaacgaggugaagcugaccaucaugaccggcgacaucaagggcaucaugcaggccggcaagagaagccugagaccccagcccaccgagcugaaguacagcuggaaggccuggggcaaggccaagaugcugagcaccgagcugcacaaccacaccuuccugaucgacggccccgagaccgccgagugccccaacaccaacagagccuggaacagccuggagguggaggacuacggcuucggcguguucaccaccaacaucuggcugaagcugaaggagagacaggacguguucugcgacagcaagcugaugagcgccgccaucaaggacaacagagccgugcacgccgacaugggcuacuggaucgagagcgcccugaacgacaccuggaagaucgagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcagacuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugaugaccaccaucggcaucgugcugcugagccagagcaccauccccgagagcauccuggagcugaccgacgcccuggcccugggcaugauggugcugaagaucgugagaaacauggagaaguaccagcuggccgugaccaucauggccauccugugcgugcccaacgccgugauccugcagaacgccuggaaggugagcugcaccacccuggccguggugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugagaugggaggagcaggccgagaucagcggcagcagccccauccugagcaucaccaucagcgaggacggcagcaugagcaucaagaacgaggaggaggagcagacccugaccauccugaucagaaccggccugcuggugaucagcggccuguuccccgugagcauccccaucaccgccgccgccugguaccugugggaggugaagaagcagagagccggcgugcugugggacgugcccagccccccccccgugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacaagggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucguggacaagaagggcaagguggugggccuguacggcaacggcguggugaccagaagcggcaccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccaucagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaagaccggcaacgacaucgccgccugccugagaaagaacggcaagaaggugauccagcugagcagaaagaccuucgacagcgaguacaucaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagagugggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacagaguggccgccgagggcaucaacuacgccgacagaagauggugcuucgacggcgugaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccaagaacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggacuucggccugggcagcaucaccacccagcagcccgagagcaacauccuggacaucgaccugagacccgccagcgccuggacccuguacgccguggccaccaccuucaucacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcuggugacccacuacgccaucaucggccccggccugcaggccaaggccaccagagaggcccagaagagagccgccgccggcaucaugaagaaccccaccguggacggcaugaccgugaucgaccuggaccccauccccuacgaccccaaguucgagaagcagcugggccaggugaugcugcuggugcugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccgccaacaccagaagaggcaccggcaacaucggcgagacccugggcgagaaguggaagaacagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaaccuggugacccccgagggcaaggugguggaccugggcugcggcagaggcggcuggagcuacuacugcggcggccugaagaacgugaaggaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccguggaggccggcagaacccugagagugcugaaccugguggagaacuggcugaacaacaacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccagcggcaacaucgugagcagcgugaacaugaucagcagaaugcugaucaacagauucaccaugagacacaagaaggccaccuacgagcccgacguggaccugggcagcggcaccagaaacaucggcaucgagagcgagacccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacgugauccccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcggcuucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacauggagggcgagcacaagaagcuggccgaggccaucuucaagcugaccuaccagaacaagguggugagagugcagagacccacccccagaggcaccgugauggacaucaucagcagaagagaccagagaggcagcggccagguggugaccuacggccugaacaccuucaccaacauggaggcccagcugaucagacagauggagggcgagggcguguucaagagcauccagcagcugaccgugaaggaggagaucgccgugaagaacuggcugaucagagugggcagagagagacugagcagaauggccaucagcggcgacgacugcguggugaagccccuggacgacagauucgccagcgcccugaccgcccugaacgacaugggcaaggugagaaaggacauccagcagugggagcccagcagaggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugagagagaccgccugccugggcaagagcuacgcccagauguggagccugauguacuuccacagaagagaccugagacuggccgccaacgccaucugcagcgccgugcccagccacugggugcccaccagcagaaccaccuggagcauccacgccacccacgaguggaugaccaccgaggacaugcugaccguguggaacagaguguggauccaggagaaccccuggauggaggacaagacccccguggagagcugggaggagauccccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 17625 - RNA, 9876 nt, Artificial Sequence
  derived and/or modified CDS sequence (opt4) from DENV-2__JN851116__SS-prME
accgccggcaucaucaucaugaugauccccaccgugauggccuuccaccugaccaccagaaacggcgagccccacaugaucgugagcagacaggagaagggcaagagccugcuguucaagaccgagaacggcgugaacaugugcacccugauggccauggaccugggcgagcugugcgaggacaccaucaccuacaacugcccccugcugagacagaacgagcccgaggacaucgacugcuggugcaacagcaccagcaccugggugaccuacggcaccugcaccgccaccggcgagcacagaagagagaagagaagcguggcccuggugccccacgugggcaugggccuggagaccagaaccgagaccuggaugagcagcgagggcgccuggaagcacgcccagagaaucgagaccuggauccugagacaccccggcuucaccaucauggccgccauccuggccuacaccaucggcaccaccuacuuccagagagugcugaucuucauccugcugaccgccgugacccccagcauggccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcaccccgccacccugagaaaguacugcguggaggccaagcugaccaacaccaccaccgccagcagaugccccacccagggcgagcccagccugaacgaggagcaggacaagagauucgugugcaagcacagcaugguggacagaggcuggggcaacggcugcggccuguucggcaagggcggcaucgugaccugcgccauguucaccugcaagaagaacauggagggcaagguggugcagcccgagaaccuggaguacaccaucgugaucaccccccacagcggcgaggagaacgccgugggcaacgacaccggcaagcacggcaaggagaucaaggugaccccccagagcagcaucaccgaggccgagcugaccggcuacggcaccgugaccauggagugcagccccagaaccggccuggacuucaacgagauggugcugcugcagauggagaacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucgugaucagagugcaguacgagggcgacggcagccccugcaagauccccuucgagaucauggaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugagcugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcguggugaucaccuggaucggcaugaacagcagaagcaccagccugagcgugagccuggugcuggugggcguggugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugaccgagaacgaggugaagcugaccaucaugaccggcgacaucaagggcaucaugcaggccggcaagagaagccugagaccccagcccaccgagcugaaguacagcuggaaggccuggggcaaggccaagaugcugagcaccgagcugcacaaccacaccuuccugaucgacggccccgagaccgccgagugccccaacaccaacagagccuggaacagccuggagguggaggacuacggcuucggcguguucaccaccaacaucuggcugaagcugaaggagagacaggacguguucugcgacagcaagcugaugagcgccgccaucaaggacaacagagccgugcacgccgacaugggcuacuggaucgagagcgcccugaacgacaccuggaagaucgagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcagacuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugaugaccaccaucggcaucgugcugcugagccagagcaccauccccgagagcauccuggagcugaccgacgcccuggcccugggcaugauggugcugaagaucgugagaaacauggagaaguaccagcuggccgugaccaucauggccauccugugcgugcccaacgccgugauccugcagaacgccuggaaggugagcugcaccauccuggccguggugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugagaugggaggagcaggccgagaucagcggcagcagccccauccugagcaucaccaucagcgaggacggcagcaugagcaucaagaacgaggaggaggagcagacccugaccauccugaucagaaccggccugcuggugaucagcggccuguuccccgugagcauccccaucaccgccgccgccugguaccugugggaggugaagaagcagagagccggcgugcugugggacgugcccagccccccccccgugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacaagggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucguggacaagaagggcaagguggugggccuguacggcaacggcguggugaccagaagcggcaccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccaucagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacaucaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagagugggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacagaguggccgccgagggcaucaacuacgccgacagaagauggugcuucgacggcgugaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccaagaacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggacuucggccugggcagcaucaccacccagcagcccgagagcaacauccuggacaucgaccugagacccgccagcgccuggacccuguacgccguggccaccaccuucaucacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaugaccgugaucgaccuggaccccauccccuacgaccccaaguucgagaagcagcugggccaggugaugcugcuggugcugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccgccaacaccagaagaggcaccggcaacaccggcgagacccugggcgagaaguggaagaacagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaaccuggugacccccgagggcaaggugguggaccugggcugcggcagaggcggcuggagcuacuacugcggcggccugaagaacgugaaggaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccguggaggccggcagaacccugagagugcugaaccugguggagaacuggcugaacaacaacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccagcggcaacaucgugagcagcgugaacaugaucagcagaaugcugaucaacagauucaccaugagacacaagaaggccaccuacgagcccgacguggaccugggcagcggcaccagaaacaucggcaucgagagcgagacccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacgugauccccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcggcuucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacauggagggcgagcacaagaagcuggccgaggccaucuucaagcugaccuaccagaacaagguggugagagugcagagacccacccccagaggcaccgugauggacaucaucagcagaagagaccagagaggcagcggccagguggugaccuacggccugaacaccuucaccaacauggaggcccagcugaucagacagauggagggcgagggcguguucaagagcauccagcagcugaccgugaaggaggagaucgccgugaagaacuggcugaucagagugggcagagagagacugagcagaauggccaucagcggcgacgacugcguggugaagccccuggacgacagauucgccagcgcccugaccgcccugaacgacaugggcaaggugagaaaggacauccagcagugggagcccagcagaggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugagagagaccgccugccugggcaagagcuacgcccagauguggagccugauguacuuccacagaagagaccugagacuggccgccaacgccaucugcagcgccgugcccagccacugggugcccaccagcagaaccaccuggagcauccacgccacccacgaguggaugaccaccgaggacaugcugaccguguggaacagaguguggauccaggagaaccccuggauggaggacaagacccccguggagagcugggaggagauccccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 17626 - RNA, 9876 nt, Artificial Sequence
  derived and/or modified CDS sequence (opt4) from DENV-2__GU370051__SS-prME
accgccggcaucaucaucaugaugauccccaccgugauggccuuccaccugaccaccagaaacggcgagccccacaugaucgugagcagacaggagaagggcaagagccugcuguucaagaccgagaacggcgugaacaugugcacccugauggccauggaccugggcgagcugugcgaggacaccaucaccuacaacugcccccugcugagacagaacgagcccgaggacaucgacugcuggugcaacagcaccagcaccugggugaccuacggcaccugcaccgccaccggcgagcacagaagagagaagagaagcguggcccuggugccccacgugggcaugggccuggagaccagaaccgagaccuggaugagcagcgagggcgccuggaagcacgcccagagaaucgagaccuggauccugagacaccccggcuucaccaucauggccgccauccuggccuacaccaucggcaccaccuacuuccagagagugcugaucuucauccugcugaccgccgugacccccagcauggccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcaccccgccacccugagaaaguacugcguggaggccaagcugaccaacaccaccaccgccagcagaugccccacccagggcgagcccagccugaacgaggagcaggacaagagauucgugugcaagcacagcaugguggacagaggcuggggcaacggcugcggccuguucggcaagggcggcaucgugaccugcgccauguucaccugcaagaagaacauggagggcaagguggugcagcccgagaaccuggaguacaccaucgugaucaccccccacagcggcgaggagaacgccgugggcaacgacaccggcaagcacggcaaggagaucaaggugaccccccagagcagcaucaccgaggccgagcugaccggcuacggcaccgugaccauggagugcagccccagaaccggccuggacuucaacgagauggugcugcugcagauggagaacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucgugaucagagugcaguacgagggcgacggcagccccugcaagauccccuucgagaucauggaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugagcugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcguggugaucaccuggaucggcaugaacagcagaagcaccagccugagcgugagccuggugcuggugggcguggugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugaccgagaacgaggugaagcugaccaucaugaccggcgacaucaagggcaucaugcaggccggcaagagaagccugagaccccagcccaccgagcugaaguacagcuggaaggccuggggcaaggccaagaugcugagcaccgagcugcacaaccacaccuuccugaucgacggccccgagaccgccgagugccccaacaccaacagagccuggaacagccuggagguggaggacuacggcuucggcguguucaccaccaacaucuggcugaagcugaaggagagacaggacguguucugcgacagcaagcugaugagcgccgccaucaaggacaacagagccgugcacgccgacaugggcuacuggaucgagagcgcccugaacgacaccuggaagaucgagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcagacuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugaugaccaccaucggcaucgugcugcugagccagagcaccauccccgagagcauccuggagcugaccgacgcccuggcccugggcaugauggugcugaagaucgugagaaacauggagaaguaccagcuggccgugaccaucauggccauccugugcgugcccaacgccgugauccuggagaacgccuggaaggugagcugcaccacccuggccguggugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugagaugggaggagcaggccgagaucagcggcagcagccccauccugagcaucaccaucagcgaggacggcagcaugagcaucaagaacgaggaggaggagcagacccugaccauccugaucagaaccggccugcuggugaucagcggccuguuccccgugagcauccccaucaccgccgccgccugguaccugugggaggugaagaagcagagagccggcgugcugugggacgugcccagccccccccccgugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacaagggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucguggacaagaagggcaagguggugggccuguacggcaacggcguggugaccagaagcggcaccuacgugagcgccaucgcccagaccgagaagagcaucgaggacaaccccgacaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccaucagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacaucaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagagugggcagaaaccccaagaacgacaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacagaguggccgccgagggcaucaacuacgccgacagaagauggugcuucgacggcgugaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccaagaacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggacuucggccugggcagcaucaccacccagcagcccgagagcaacauccuggacaucgaccugagacccgccagcgccuggacccuguacgccguggccaccaccuucaucacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggaccccauccccuacgaccccaaguucgagaagcagcugggccaggugaugcugcuggugcugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccgccaacaccagaagaggcaccggcaacaccggcgagacccugggcgagaaguggaagaacagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaaccuggugacccccgagggcaaggugguggaccugggcugcggcagaggcggcuggagcuacuacugcggcggccugaagaacgugaaggaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccguggaggccggcagaacccugagagugcugaaccugguggagaacuggcugaacaacaacacccaguucugcaucaaggugcugacccccuacaugcccagcgugaucgagaagauggaggcccugcagagaaaguacggcggcgcccuggugagaaacccccugagcagaaacagcacccacgagauguacugggugagcaacgccagcggcaacaucgugagcagcgugaacaugaucagcagaaugcugaucaacagauucaccaugagacacaagaaggccaccuacgagcccgacguggaccugggcagcggcaccagaaacaucggcaucgagagcgagacccccaaccuggacaucaucggcaagagaaucggcaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacgugauccccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcggcuucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacauggagggcgagcacaagaagcuggccgaggccaucuucaagcugaccuaccagaacaagguggugagagugcagagacccacccccagaggcaccgugauggacaucaucagcagaagagaccagagaggcagcggccagguggugaccuacggccugaacaccuucaccaacauggaggcccagcugaucagacagauggagggcgagggcguguucaagagcauccagcagcugaccgugaaggaggagaucgccguggagaacuggcugaugagagugggcagagagagacugagcagaauggccaucagcggcgacgacugcguggugaagccccuggacgacagauucgccagcgcccugaccgcccugaacgacaugggcaaggugagaaaggacauccagcagugggagcccagcagaggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugagagagaccgccugccugggcaagagcuacgcccagauguggagccugauguacuuccacagaagagaccugagacuggccgccaacgccaucugcagcgccgugcccagccacugggugcccaccagcagaaccaccuggagcauccacgccacccacgaguggaugaccaccgaggacaugcugaccguguggaacagaguguggauccaggagaaccccuggauggaggacaagacccccguggagagcugggaggagauccccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 17627 - RNA, 9876 nt, Artificial Sequence
  derived and/or modified CDS sequence (opt4) from DENV-2__EU359009__SS-prME
accgccggcaucaucaucaugaugauccccaccgugauggccuuccaccugaccaccagaaacggcgagccccacaugaucgugagcagacaggagaagggcaagagccugcuguucaagaccgagaacggcgugaacaugugcacccugauggccauggaccugggcgagcugugcgaggacaccaucaccuacaacugcccccugcugagacagaacgagcccgaggacaucgacugcuggugcaacagcaccagcaccugggugaccuacggcaccugcaccgccaccggcgagcacagaagagagaagagaagcguggcccuggugccccacgugggcaugggccuggagaccagaaccgagaccuggaugagcagcgagggcgccuggaagcacgcccagagaaucgagaccugggugcugagacaccccggcuucaccaucauggccgccauccuggccuacaccaucggcaccaccuacuuccagagagugcugaucuucauccugcugaccgccaucgcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcaccccgccacccugagaaaguacugcaucgaggccaagcugaccaacaccaccaccgccagcagaugccccacccagggcgagcccagccugaacgaggagcaggacaagagauucgugugcaagcacagcaugguggacagaggcuggggcaacggcugcggccuguucggcaagggcggcaucgugaccugcgccauguucaccugcaagaagaacauggagggcaagaucgugcagcccgagaaccuggaguacaccaucgugaucaccccccacagcggcgaggagaacgccgugggcaacgacaccggcaagcacggcaaggagaucaaggugaccccccagagcagcaucaccgaggccgagcugaccggcuacggcaccgugaccauggagugcagccccagaaccggccuggacuucaacgagauggugcugcugcagauggagaacaaggccuggcuggugcacagacagugguuccuggaccugcccuuccccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucgugaucagagugcaguacgagggcgacggcagccccugcaagauccccuucgagaucauggaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugagcugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcguggugaucaccuggaucggcaugaacagcagaagcaccagccugagcgugagccuggugcuggugggcguggugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaaggccuggggcaaggccaagaugcugagcaccgagcugcacaaccacaccuuccugaucgacggccccgagaccgccgagugccccaacaccaacagagccuggaacagccuggagguggaggacuacggcuucggcguguucaccaccaacaucuggcugaagcugaaggagagacaggacguguucugcgacagcaagcugaugagcgccgccaucaaggacaacagagccgugcacgccgacaugggcuacuggaucgagagcgcccugaacgacaccuggaagaucgagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcagacuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugaugaccaccaucggcaucgugcugcugagccagagcaccauccccgagaccauccuggagcugaccgacgcccuggcccugggcaugauggugcugaagaucgugagaaacauggagaaguaccagcuggccgugaccaucauggccauccugugcgugcccaacgccgugauccugcagaacgccuggaaggugagcugcaccacccuggccguggugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugagaugggaggagcaggccgagaucagcggcagcagccccauccugagcaucaccaucagcgaggacggcagcaugagcaucaagaacgaggaggaggagcagacccugaccauccugaucagaaccggccugcuggugaucagcggccuguuccccgugagcauccccaucaccgccgccgccugguaccugugggaggugaagaagcagagagccggcgugcugugggacgugcccagccccccccccgugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacaagggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucguggacaagaagggcaagguggugggccuguacggcaacggcguggugaccagaagcggcaccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccaucagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacaccgaguacaucaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagagugggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacagaguggccgccgagggcaucaacuacgccgacagaagauggugcuucgacggcgugaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagaaacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggacuucggccugggcagcaucaccacccagcagcccgagagcaacauccuggacaucgaccugagacccgccagcgccuggacccuguacgccguggccaccaccuucaucacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggaccccauccccuacgaccccaaguucgagaagcagcugggccaggugaugcugcuggugcugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccgccaacaccagaagaggcaccggcaacaccggcgagacccugggcgagaaguggaagaacagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaaccuggugacccccgagggcaaggugguggaccugggcugcggcagaggcggcuggagcuacuacugcggcggccugaagaacgugaaggaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccguggaggccggcagaacccugagagugcugaaccugguggagaacuggcugaacaacaacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccagcggcaacaucgugagcagcgugaacaugaucagcagaaugcugaucaacagauucaccaugagacacaagaaggccaccuacgagcccgacguggaccugggcagcggcaccagaaacaucggcaucgagagcgagacccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacgugauccccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcggcuucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacauggagggcgagcacaagaagcuggccgaggccaucuucagacugaccuaccagaacaagguggugagagugcagagacccacccccagaggcaccgugauggacaucaucagcagaagagaccagagaggcagcggccagguggugaccuacggccugaacaccuucaccaacauggaggcccagcugaucagacagauggagggcgagggcguguucaagagcauccagcaccugaccgugaccgaggagaucgccgugaagaacuggcuggugagagugggcagagagagacugagcagaauggccaucagcggcgacgacugcguggugaagccccuggacgacagauucgccagcgcccugaccgcccugaacgacaugggcaaggugagaaaggacauccagcagugggagcccagcagaggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugagagagaccgccugccugggcaagagcuacgcccagauguggagccugauguacuuccacagaagagaccugagacuggccgccaacgccaucugcagcgccgugcccagccacugggugcccaccagcagaaccaccuggagcauccacgccacccacgaguggaugaccaccgaggacaugcugaccguguggaacagaguguggauccaggagaaccccuggauggaggacaagacccccguggagagcugggaggagauccccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 17628 - RNA, 9876 nt, Artificial Sequence
  derived and/or modified CDS sequence (opt4) from DENV-2__KC131142__SS-prME
accgccggcaucaucaucauggugauccccaccgugauggccuuccaccugaccaccagaaacggcgagccccacaugaucgugagcagacaggagaagggcaagagccugcuguucaagaccgagaacggccugaacaugugcacccugauggccauggaccugggcgagcugugcgaggacaccaucaccuacaacugcccccugcugagacagaacgagcccgaggacaucgacugcuggugcaacagcaccagcaccugggugaccuacggcaccugcaccgccaccggcgagcacagaagagagaagagaagcguggcccuggugccccacgugggcaugggccuggagaccagaaccgagaccuggaugagcagcgagggcgccuggaagcacgcccagagaaucgagaccugggugcugagacaccccggcuucaccaucauggccgccauccuggccuacaccaucggcaccaccuacuuccagagagugcugaucuucauccugcugaccgccaucgcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcaccccgccacccugagaaaguacugcaucgaggccaagcugaccaacaccaccaccgccagcagaugccccacccagggcgagcccagccugaacgaggagcaggacaagagauucgugugcaagcacagcaugguggacagaggcuggggcaacggcugcggccuguucggcaagggcggcaucgugaccugcgccauguucaccugcaagaagaacauggagggcaagaucgugcagcccgagaaccuggaguacaccaucgugaucaccccccacagcggcgaggagaacgccgugggcaacgacaccggcaagcacggcaaggagaucaaggugaccccccagagcagcaucaccgaggccgagcugaccggcuacggcaccgugaccauggagugcagccccagaaccggccuggacuucaacgagauggugcugcugcagauggagaacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucgugaucagagugcaguacgagggcgacggcagccccugcaagauccccuucgagaucauggaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugagcugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcguggugaucaccuggaucggcaugaacagcagaagcaccagccugagcgugagccuggugcuggugggcguggugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaaggccuggggcaaggccaagaugcugagcaccgagcugcacaaccacaccuuccugaucgacggccccgagaccgccgagugccccaacaccaacagagccuggaacagccuggagguggaggacuacggcuucggcguguucaccaccaacaucuggcugaagcugaaggagagacaggacguguucugcgacagcaagcugaugagcgccgccaucaaggacaacagagccgugcacgccgacaugggcuacuggaucgagagcgcccugaacgacaccuggaagaucgagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcagacuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugaugaccaccaucggcaucgugcugcugagccagagcaccauccccgagaccauccuggagcugaccgacgcccuggcccugggcaugauggugcugaagaucgugagaaacauggagaaguaccagcuggccgugaccaucauggccauccugugcgugcccaacgccgugauccugcagaacgccuggaaggugagcugcaccacccuggccguggugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugagaugggaggagcaggccgagaucagcggcagcagccccauccugagcaucaccaucagcgaggacggcagcaugagcaucaagaacgaggaggaggagcagacccugaccauccugaucagaaccggccugcuggugaucagcggccuguuccccgugagcauccccaucaccgccgccgccugguaccugugggaggugaagaagcagagagccggcgugcugugggacgugcccagccccccccccgugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacaagggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucguggacaagaagggcaagguggugggccuguacggcaacggcguggugaccagaagcggcaccuacgugagcgccaucgcccagaccgagaagagcaucgaggacaaccuggagaucgaggacgacaucuucagaaagaagagacugaccgugauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccaucagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacaccgaguacaucaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagagugggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacagaguggccgccgagggcaucaacuacgccgacagaagauggugcuucgacggcgugaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagaaacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggacuucggccugggcagcaucaccacccagcagcccgagagcaacauccuggacaucgaccugagacccgccagcgccuggacccuguacgccguggccaccaccuucaucacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggaccccauccccuacgaccccaaguucgagaagcagcugggccaggugaugcugcuggugcugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccgccaacaccagaagaggcaccggcaacaccggcgagacccugggcgagaaguggaagaacagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaaccuggugacccccgagggcaaggugguggaccugggcugcggcagaggcggcuggagcuacuacugcggcggccugaagaacgugaaggaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccguggaggccggcagaacccugagagugcugaaccugguggagaacuggcugaacaacaacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccagcggcaacaucgugagcagcgugaacaugaucagcagaaugcugaucaacagauucaccaugagacacaagaaggccaccuacgagcccgacguggaccugggcagcggcaccagaaacaucggcaucgagagcgagacccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugaagcugcugaccaagcccugggacgugauccccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagaggcgccguggaggacagcggcuucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacauggagggcgugcacaagaagcuggccgaggccaucuucagacugaccuaccagaacaagguggugagagugcagagacccacccccagaggcaccgugauggacaucaucagcagaagagaccagagaggcagcggccagguggugaccuacggccugaacaccuucaccaacauggaggcccagcugaucagacagauggagggcgagggcguguucaagagcauccagcaccugaccgugaccgaggagaucgccgugaagaacuggcuggugagagugggcagagagagacugagcagaauggccaucagcggcgacgacugcguggugaagccccuggacgacagauucgccagcgcccugaccgcccugaacgacaugggcaaggugagaaaggacauccagcagugggagcccagcagaggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugagagagaccgccugccugggcaagagcuacgcccagauguggagccugauguacuuccacagaagagaccugagacuggccgccaacgccaucugcagcgccgugcccagccacugggugcccaccagcagaaccaccuggagcauccacgccacccacgaguggaugaccaccgaggacaugcugaccguguggaacagaguguggauccaggagaaccccuggauggaggacaagacccccguggagagcugggaggagauccccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 17629 - RNA, 9876 nt, Artificial Sequence
  derived and/or modified CDS sequence (opt4) from DENV-2__AY858035__SS-prME
accgccggcaucaucaucaugaugauccccaccgugauggccuuccaccugaccaccagaaacggcgagccccacaugaucgugagcagacaggagaagggcaagagccugcuguucaagaccgagaacggcgugaacaugugcacccugauggccauggaccugggcgagcugugcgaggacaccaucaccuacaacugcccccugcugagacagaacgagcccgaggacaucgacugcuggugcaacagcaccagcaccugggugaccuacggcaccugcaccgccaccggcgagcacagaagagagaagagaagcguggcccuggugccccacgugggcaugggccuggagaccagaaccgagaccuggaugagcagcgagggcgccuggaagcacgcccagagaaucgagaccugggugcugagacaccccggcuucaccaucauggccgccauccuggccuacaccaucggcaccaccuacuuccagagagugcugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcaccccgccacccugagaaaguacugcaucgaggccaagcugaccaacaccaccaccgccagcagaugccccacccagggcgagcccagccugaacgaggagcaggacaagagauucgugugcaagcacagcaugguggacagaggcuggggcaacggcugcggccuguucggcaagggcggcaucgugaccugcgccauguucaccugcaagaagaacauggagggcaagaucgugcagcccgagaaccuggaguacaccaucgugaucaccccccacagcggcgaggagaacgccgugggcaacgacaccggcaagcacggcaaggagaucaaggugaccccccagagcagcaucaccgaggccgagcugaccggcuacggcaccgugaccauggagugcagccccagaaccggccuggacuucaacgagauggugcugcugcagauggagaacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucgugaucagagugcaguacgagggcgacggcagccccugcaagauccccuucgagaucauggaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugagcugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcguggugaucaccuggaucggcaugaacagcagaagcaccagccugagcgugagccuggugcuggugggcguggugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagcugcacaaccacaccuuccugaucgacggccccgagaccgccgagugccccaacaccaacagagccuggaacagccuggagguggaggacuacggcuucggcguguucaccaccaacaucuggcugaagcugaaggagagacaggacguguucugcgacagcaagcugaugagcgccgccaucaaggacaacagagccgugcacgccgacaugggcuacuggaucgagagcgcccugaacgacaccuggaagaucgagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcagacuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugaugaccaccaucggcaucgugcugcugagccagagcaccauccccgagaccauccuggagcugaccgacgcccuggcccugggcaugauggugcugaagaucgugagaaacauggagaaguaccagcuggccgugaccaucauggccauccugugcgugcccaacgccgugauccugcagaacgccuggaaggugagcugcaccacccuggccguggugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugagaugggaggagcaggccgagaucagcggcagcagccccauccugagcaucaccaucagcgaggacggcagcaugagcaucaagaacgaggaggaggagcagacccugaccauccugaucagaaccggccugcugguggugagcggccuguuccccgugagcauccccaucaccgccgccgccugguaccugugggaggugaagaagcagagagccggcgugcugugggacgugcccagccccccccccgugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacaagggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucguggacaagaagggcaagguggugggccuguacggcaacggcguggugaccagaagcggcaccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccaucagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacaucaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagagugggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaagauggugcuucgacggcgugaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagaaacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggacuucggccugggcagcaucaccacccagcagcccgagagcaacauccuggacaucgaccugagacccgccagcgccuggacccuguacgccguggccaccaccuucaucacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggaccccauccccuacgaccccaaguucgagaagcagcugggccaggugaugcugcuggugcugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccgccaacaccagaagaggcaccggcaacaccggcgagacccugggcgagaaguggaagaacagacugaacacccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaaccuggugacccccgagggcaaggugguggaccugggcugcggcagaggcggcuggagcuacuacugcggcggccugaagaacgugaaggaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccguggaggccggcagaacccugagagugcugaaccugguggagaacuggcugaacaacaacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccagcggcaacaucgugagcagcgugaacaugaucagcagaaugcugaucaacagauucaccaugagacacaagaaggccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacgugauccccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagaccagaagaaugugcaccagagaggaguucaccagaaaggugagaagcaacgccgcccugggcgccaucuucaccgacgagaacaaguggaagagcgccagagaggccguggaggacagcggcuucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacauggagggcgagcacaagaagcuggccgaggccaucuucaagcugaccuaccagaacaagguggugagagugcagagacccacccccagaggcaccgugauggacaucaucagcagaagagaccagagaggcagcggccagguggugaccuacggccugaacaccuucaccaacauggaggcccagcugaucagacagauggagggcgagggcguguucaagagcauccagcagcugaccgugaccgaggagaucgccgugaagaacuggcuggagagagugggcagagagagacugagcagaauggccaucagcggcgacgacugcguggugaagccccuggacgacagauucgccagcgcccugaccgcccugaacgacaugggcaaggugagaaaggacauccagcagugggagcccagcagaggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugagagagaccgccugccugggcaagagcuacgcccagauguggagccugauguacuuccacagaagagaccugagacuggccgccaacgccaucugcagcgccgugcccagccacugggugcccaccagcagaaccaccuggagcauccacgccacccacgaguggaugaccaccgaggacaugcugaccguguggaacagaguguggauccaggagaaccccuggauggaggacaagacccccguggagagcugggaggagauccccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 17630 - RNA, 9873 nt, Artificial Sequence
  derived and/or modified CDS sequence (opt4) from DENV-2__JX567951__SS-prME
accgccggcgugaucgugaugcugauccccaccgccauggccuuccaccugaccaccagaaacggcgagccccacaugaucgugggcagacaggagaagggcaagagccugcuguucaagaccgaggacggcgugaacaugugcacccugauggccaucgaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgugcagagaaucgagaccuggauccugagacaccccggcuucaccaucauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaacgaggagcaggacaagagauucaucugcaagcacagcaugguggacagaggcuggggcaacggcugcggccuguucggcaagggcggcaucgugaccugcgccauguucaccugcaagaagaacauggagggcaagaucgugcagcccgagaaccuggaguacaccaucgugaucaccccccacagcggcgaggagcacgccgugggcaacgacaccggcaagcacggcaaggagaucaagaucaccccccagagcagcaccaccgaggccgagcugaccggcuacggcaccgugaccauggagugcagccccagaaccggccuggacuucaacgagauggugcugcugcagauggaggacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagaucgugaaggagaucgccgagacccagcacggcaccaucgugaucagagugcaguacgagggcgacggcagccccugcaagauccccuucgagaucaccgaccuggagaagagacacgugcugggcagacugaucaccgugaaccccaucgugaccgagaaggacagccccgugaacaucgaggccgagccccccuucggcgacagcuacaucaucgugggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcguggugacccuguaccugggcgccauggugcaggccgacagcggcugcaucgugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucaccaccaacaucuggcugaagcugagagagaagcaggacguguucugcgacagcaagcugaugagcgccgccaucaaggacaacagagccgugcacgccgacaugggcuacuggaucgagagcgcccugaacgacaccuggaagauggagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcaagcuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugguggcccugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugauggccaccaucggcaucgcccugcugagccagagcacccugcccgagaccauccuggagcugaccgacgcccuggcccugggcaugauggcccugaagaucgugagaaacauggagaaguaccagcuggccgugaccaucauggccaucagcugcgugcccaacgccgugauccugcagaacgccuggaaggugagcugcaccauccuggccgccgugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggcguguuccccgugagcauccccaucaccgccgccgccugguaccugugggaggugaagaagcagagagccggcgugcugugggacgugcccagccccccccccgugggcaaggccgagcuggaggacggcgccuacagaaucaagcagagaggcauccugggcuacagccagaucggcgccggcguguacaaggagggcaccuuccacaccauguggcacgugaccagaggcgccgugcugaugcacagaggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggcaucuucaagaccaacaccggcaccaucggcgccgugagccuggacuucagccccggcaccagcggcagccccaucguggacagaaagggcaagguggugggccuguacggcaacggcguggugaccagaagcggcgccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagagccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaaaguggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagaaacgcccuggacaaccuggccgugcugcacaccgccgaggugggcggcaaggccuacacccacgcccugagcgagcugcccgagacccuggagacccugcugcugcugacccugcuggccgccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggcuucggcagcaucaccacccaggagagcgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggagcccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacgugggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccaucgaggccggcagaacccugagagugcugaaccugguggagaacuggcugaacaacaacacccaguucugcaucaaggugcugaaccccuacaugcccagcgugaucgagaagauggagacccugcagagaaaguacggcggcgcccuggugagaaacccccugagcagaaacagcacccacgagauguacugggugagcaacgccaccggcaacaucgugagcagcgugaacaugaucagcagaaugcugaucaacagauucaccaugaagcacaagaaggccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacguggugcccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaaggagaagacccccagaaugugcaccagagaggaguucaccagaaaggugagaagcaacgccgcccugggcgccguguucaccgacgagaacaaguggaagagcgccagagaggccguggaggacggcagauucugggagcugguggacagagagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagaggcaacagccugagcggcguggagggcgagggccugcacagacugggcuacauccugagagaggugggcaagaaggagggcggcgccauguacgccgacgacaccgccggcugggacaccagaaucacccuggaggaccugaagaacgaggagauggugaccaaccacaugaagggcgagcacaagaagcuggccgaggccaucuucaagcugaccuaccagaacaagguggugagagugcagagacccacccccagaggcaccgugauggacaucaucagcagaaaggaccagagaggcagcggccaggugggcaccuacggccugaacaccuucaccaacauggaggcccagcugaucagacagauggagggcgagggcaucuucaagagcauccagcaccugaccgccaccgaggagaucgccgugcagaacuggcuggccagagugggcagagagagacugagcagaauggccaucagcggcgacgacugcguggugaagcccaucgacgacagauucgccagcgcccugaccgcccugaacgacaugggcaaggugagaaaggacauccagcagugggagcccagcagaggcuggaacgacuggacccaggugcccuucugcagccaccacuuccacgagcuggugaugaaggacggcagagugcugguggugcccugcagaaaccaggacgagcugaucggcagagccagaaucagccagggcgccggcuggagccugaaggagaccgccugccugggcaagagcuacgcccagauguggacccugauguacuuccacagaagagaccugagacuggccgccaacgccaucugcagcgccgugcccagccacugggugcccaccagcagaaccaccuggagcauccacgccaagcacgaguggaugaccaccgaggacaugcuggccguguggaacagaguguggauccaggagaaccccuggauggaggacaagacccccguggagagcugggaggaggugcccuaccugggcaagagagaggaccaguggugcggcagccugaucggccugaccagcagagccaccugggccaagaacauccagaccgccaucaaccaggugagaagccugaucggcaacgagggcuacaccgacuacaugcccagcaugaagagauucagaagagaggaggaggaggccggcgugcugugg

SEQ ID NO: 17631 - RNA, 9873 nt, Artificial Sequence
  derived and/or modified CDS sequence (opt4) from DENV-2__JX567950__SS-prME
accgccggcgugaucgugaugcugauccccaccgccauggccuuccaccugaccaccagaaacggcgagccccacaugaucgugggcagacaggagaagggcaagagccugcuguucaagaccgaggacggcgugaacaugugcacccugauggccaucgaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgugcagagaaucgagaccuggauccugagacaccccggcuucaccaucauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaacgaggagcaggacaagagauucaucugcaagcacagcaugguggacagaggcuggggcaacggcugcggccuguucggcaagggcggcaucgugaccugcgccauguucaccugcaagaagaacauggagggcaagguggugcugcccgagaaccuggaguacaccaucgugaucaccccccacagcggcgaggagcacgccgugggcaacgacaccggcaagcacggcgaggagaucaagaucaccccccagagcagcaucaccgaggccgagcugaccggcuacggcaccgugaccauggagugcagccccagaaccggccuggacuucaacgagauggugcugcugcagauggaggacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagaucgugaaggagaucgccgagacccagcacggcaccaucgugaucagagugcaguacgagggcgacggcagccccugcaagauccccuucgagaucaccgaccuggagaagagacacgugcugggcagacugaucaccgugaaccccaucgugaccgagaaggacagccccgugaacaucgaggccgagccccccuucggcgacagcuacaucaucgugggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcguggugacccuguaccugggcgccauggugcaggccgacagcggcugcaucgugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucaccaccaacaucuggcugaagcugagagagaagcaggacguguucugcgacagcaagcugaugagcgccgccaucaaggacaacagagccgugcacgccgacaugggcuacuggaucgagagcgcccugaacgacaccuggaagauggagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcaagcuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugguggcccugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugauggccaccaucggcaucgcccugcugagccagagcacccugcccgagaccauccuggagcugaccgacgcccuggcccugggcaugauggcccugaagaucgugagaaacauggagaaguaccagcuggccgugaccaucauggccaucagcugcgugcccaacgccgugauccugcagaacgccuggaaggugagcugcaccauccuggccgccgugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugaagugggaggaccaggccgagaucagcggcagcagccccauccugagcgugaccaucagcgaggacggcagcaugagcaucaagaacgaggaggaggagcagacccugaccauccugaucagaaccggccugcuggugaucagcggcguguuccccgugagcauccccaucaccgccgccgccugguaccugugggaggugaagaagcagagagccggcgugcugugggacgugcccagccccccccccgugggcaaggccgagcuggaggacggcgccuacagaaucaagcagagaggcauccugggcuacagccagaucggcgccggcguguacaaggagggcaccuuccacaccauguggcacgugaccagaggcgccgugcugaugcacagaggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggcaucuucaagaccaacaccggcaccaucggcgccgugagccuggacuucagccccggcaccagcggcagccccaucguggacagaaagggcaagguggugggccuguacggcaacggcguggugaccagaagcggcgccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucagcgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagagccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaaaguggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagaaacgcccuggacaaccuggccgugcugcacaccgccgaggugggcggcaaggccuacacccacgcccugaacgagcugcccgagacccuggagacccugcugcugcugacccugcuggccgccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaguaccugggccugggcagcaucaccacccaggagagcgagagcaacauccuggacaucgaccugagacccgccagcgccuggacccuguacgccguggccaccaccuucgugacccccaugcugagacacagcaucgugaacagcagcgugaacgugacccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggagcccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacgugggcgagacccugggcgagaaguggaagagcagacugaacgcccugggcaagaacgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccaucgaggccggcagaacccugagagugcugaaccuggccgagaacuggcugaacaacaacacccaguucugcaucaaggugcugaaccccuacaugcccagcgugaucgagaagauggagacccugcagagaaaguacggcggcgcccuggugagaaacccccugagcagaaacagcacccacgagauguacugggugagcaacgccaccggcaacaucgugagcagcgugaacaugaucagcagaaugcugaucaacagauucaccaugaagcacaagaaggccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacguggugcccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaaggagaagacccccagaaugugcaccagagaggaguucaccagaaaggugagaagcaacgccgcccugggcgccguguucaccgacgagaacaaguggaagagcgccagagaggccguggaggacggcagauucugggagcugguggacagagagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacagacugggcuacauccugagagacgugagcaagaaggagggcggcgccauguacgccgacgacaccgccggcugggacaccagaaucacccuggaggaccugaagaacgaggagauggugaccaaccacaugaagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcaucuucaagagcauccagcaccugaccgccaccgaggagaucgccgugcagaacuggcuggccagagugggcagagagagacugagcagaauggccaucagcggcgacgacugcguggugaagcccaucgacgacagauucgccagcgcccugaccgcccugaacgacaugggcaaggugagaaaggacauccagcagugggagcccagcagaggcuggaacgacuggacccaggugcccuucugcagccaccacuuccacgagcuggugaugaaggacggcagagugcugguggugcccugcagaaaccaggacgagcugaucggcagagccagaaucagccagggcgccggcuggagccugaaggagaccgccugccugggcaagagcuacgcccagauguggacccugauguacuuccacagaagagaccugagacuggccgccaacgccaucugcagcgccgugcccagccacugggugcccaccagcagaaccaccuggagcauccacgccaagcacgaguggaugaccaccgaggacaugcuggccguguggaacagaguguggauccaggagaaccccuggauggaggacaagacccccguggagagcugggaggagauccccuaccugggcaagagagaggaccaguggugcggcagccugaucggccugaccagcagagccaccugggccaagaacauccagaccgccaucaaccaggugagaagccugaucggcaacgagggcuacaccgacuacaugcccagcaugaagagauucagaagagaggaggaggaggccggcgugcugugg

SEQ ID NO: 17632 - RNA, 9873 nt, Artificial Sequence
  derived and/or modified CDS sequence (opt4) from DENV-2__HQ012538__SS-prME
accgccggcgugaucaucaugcugauccccaccgccauggccuuccaccugaccaccagaaacggcgagccccacaugaucgugggcagacaggagaagggcaagagccugcuguucaagaccgaggacggcgugaacaugugcacccugauggccaucgaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgugcagagaaucgagaccuggauccugagacaccccggcuucgccaucauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaacgaggagcaggacaagagauucaucugcaagcacagcaugguggacagaggcuggggcaacggcugcggccuguucggcaagggcggcaucgugaccugcgccauguucaccugcaagaagaacauggagggcaagguggugcugcccgagaaccuggaguacaccaucgugaucaccccccacagcggcgaggagcacgccgugggcaacgacaccggcaagcacggcgaggagaucaagaucaccccccagagcagcaucaccgaggccgagcugaccggcuacggcaccgugaccauggagugcagccccagaaccggccuggacuucaacgagauggugcugcugcagauggaggagaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagaucgugaaggagaucgccgagacccagcacggcaccaucgugaucagagugcaguacgagggcgacggcagccccugcaagauccccuucgagaucauggaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcguggugacccuguaccugggcgccauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucaccaccaacaucuggcugaagcugagagagaagcaggacguguucugcgacagcaagcugaugagcgccgccaucaaggacaacagagccgugcacgccgacaugggcuacuggaucgagagcgcccugaacgacaccuggaagauggagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcaagcuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugguggccgugagcuucgugacccugaucaccggcaacaugagcuucagagaccugggcagagugauggugauggugggcgugaccaugaccgacgacaucggcaugggcgugaccuaccuggcccugcuggccgccuucaaggugagacccaccuucgccgccggccugcugcugagaaagcugaccagcaaggagcugaugauggccaccaucggcaucgcccugcugagccagagcaccauccccgagaccauccuggagcugaccgacgcccuggcccugggcaugauggugcugaagaucgugagaaacauggagaaguaccagcuggccgugaccaucauggccaucagcugcgugcccaacgccgugauccugcugaacgccuggaaggugagcugcaccauccuggccgccgugagcgugagcccccugcugcugaccagcagccagcagaagaccgacuggaucccccuggcccugaccaucaagggccugaaccccaccgccaucuuccugaccacccugagcagaaccagcaagaagagaagcuggccccugaacgaggccgugauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggcguguuccccgugagcauccccaucaccgccgccgccugguaccugugggaggugaagaagcagagagccggcgugcugugggacgugcccagccccccccccguggagaaggccgagcuggaggacggcgccuacagaaucaagcagagaggcauccugggcuacagccagaucggcgccggcguguacaaggagggcaccuuccacaccauguggcacgugaccagaggcgccgugcugaugcacagaggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucguggacagaaagggcaagguggugggccuguacggcaacggcguggugaccagaagcggcgccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagagccaacgacugggacuucguggugaccaccgacaucagcgagaugggcgccaacuucagagccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacagaguggccgccgagggcaucaacuacgccgacagaagauggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagagacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucaccacccaggagagcgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggagcccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccaucgaggccggcagaacccugagagugcugaaccugguggagaacuggcugaacaacaacacccaguucugcaucaaggugcugaaccccuacaugcccagcgugaucgagaagauggagacccugcagagaaaguacggcggcgcccuggugagaaacccccugagcagaaacagcacccacgagauguacugggugagcaacgccaccggcaacaucgugagcagcgugaacaugaucagcagaaugcugaucaacagauucaccaugaagcacaagaaggccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacguggugcccauggugacccagauggccaugaccgacaccacccccuucggccagcagagaguguucaaggagaagguggacaccagaacccaggagcccaaggagggcaccaagaagcugaugagaaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcagauucugggagcugguggacagagagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagaggcaacagccugagcggcguggagggcgagggccugcacagacugggcuacauccugagagacgugagcaagaaggagggcggcgccauguacgccgacgacaccgccggcugggacaccagaaucacccuggaggaccugaagaacgaggagauggugaccaaccacaugaagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcaucuucaagagcauccagcaccugaccgugaccgaggagaucgccgugcagaacuggcuggccagagugggcagagagagacugagcagaauggccaucagcggcgacgacugcguggugaagccccuggacgacagauucgccagcgcccugaccgcccugaacgacaugggcaaggugagaaaggacauccagcagugggagcccagcagaggcuggaacgacuggacccaggugcccuucugcagccaccacuuccacgagcuggugaugaaggacggcagagugcugguggugcccugcagaaaccaggacgagcugaucggcagagccagaaucagccagggcgccggcuggagccugaaggagaccgccugccugggcaagagcuacgcccagauguggacccugauguacuuccacagaagagaccugagacuggccgccaacgccaucugcagcgccgugcccagccacugggugcccaccagcagaaccaccuggagcauccacgccaagcacgaguggaugaccaccgaggacaugcuggccguguggaacagaguguggauccaggagaaccccuggauggaggacaagacccccguggagagcugggaggaggugcccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugg

SEQ ID NO: 17633 - RNA, 9873 nt, Artificial Sequence
  derived and/or modified CDS sequence (opt4) from DENV-2__HQ012533__SS-prME
accgccggcgugaucaucaugcugauccccaccgccauggccuuccaccugaccaccagaaacggcgagccccacaugaucgugggcagacaggagaagggcaagagccugcuguucaagaccgaggacggcgugaacaugugcacccugauggccaucgaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgugcagagaaucgagaccuggauccugagacaccccggcuucgccaucauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaacgaggagcaggacaagagauucaucugcaagcacagcaugguggacagaggcuggggcaacggcugcggccuguucggcaagggcggcaucgugaccugcgccauguucaccugcaagaagaacauggagggcaagguggugcugcccgagaaccuggaguacaccaucgugaucaccccccacagcggcgaggagcacgccgugggcaacgacaccggcaagcacggcgaggagaucaagaucaccccccagagcagcaucaccgaggccgagcugaccggcuacggcaccgugaccauggagugcagccccagaaccggccuggacuucaacgagauggugcugcugcagauggaggagaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagaucgugaaggagaucgccgagacccagcacggcaccaucgugaucagagugcaguacgagggcgacggcagccccugcaagauccccuucgagaucauggaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcguggugacccuguaccugggcgccauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucaccaccaacaucuggcugaagcugagagagaagcaggacguguucugcgacagcaagcugaugagcgccgccaucaaggacaacagagccgugcacgccgacaugggcuacuggaucgagagcgcccugaacgacaccuggaagauggagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcaagcuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugguggccgugagcuucgugacccugaucaccggcaacaugagcuucagagaccugggcagagugauggugauggugggcgugaccaugaccgacgacaucggcaugggcgugaccuaccuggcccugcuggccgccuucaaggugagacccaccuucgccgccggccugcugcugagaaagcugaccagcaaggagcugaugauggccaccaucggcaucgcccugcugagccagagcaccauccccgagaccauccuggagcugaccgacgcccuggcccugggcaugauggugcugaagaucgugagaaacauggagaaguaccagcuggccgugaccaucauggccaucagcugcgugcccaacgccgugauccugcugaacgccuggaaggugagcugcaccauccuggccgccgugagcgugagcccccugcugcugaccagcagccagcagaagaccgacuggaucccccuggcccugaccaucaagggccugaaccccaccgccaucuuccugaccacccugagcagaaccagcaagaagagaagcuggccccugaacgaggccgugauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggcguguuccccgugagcauccccaucaccgccgccgccugguaccugugggaggugaagaagcagagagccggcgugcugugggacgugcccagccccccccccgugggcaaggccgagcuggaggacggcgccuacagaaucaagcagagaggcauccugggcuacagccagaucggcgccggcguguacaaggagggcaccuuccacaccauguggcacgugaccagaggcgccgugcugaugcacagaggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucguggacagaaagggcaagguggugggccuguacggcaacggcguggugaccagaagcggcgccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagagccaacgacugggacuucguggugaccaccgacaucagcgagaugggcgccaacuucagagccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacagaguggccgccgagggcaucaacuacgccgacagaagauggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagagacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucaccacccaggagagcgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggagcccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccaucgaggccggcagaacccugagagugcugaaccugguggagaacuggcugaacaacaacacccaguucugcaucaaggugcugaaccccuacaugcccagcgugaucgagaagauggagacccugcagagaaaguacggcggcgcccuggugagaaacccccugagcagaaacagcacccacgagauguacugggugagcaacgccaccggcaacaucgugagcagcgugaacaugaucagcagaaugcugaucaacagauucaccaugaagcacaagaaggccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacguggugcccauggugacccagauggccaugaccgacaccacccccuucggccagcagagaguguucaaggagaagguggacaccagaacccaggagcccaaggagggcaccaagaagcugaugagaaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcagauucugggagcugguggacagagagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagaggcaacagccugagcggcguggagggcgagggccugcacagacugggcuacauccugagagacgugagcaagaaggagggcggcgccauguacgccgacgacaccgccggcugggacaccagaaucacccuggaggaccugaagaacgaggagauggugaccaaccacaugaagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcaucuucaagagcauccagcaccugaccgugaccgaggagaucgccgugcagaacuggcuggccagagugggcagagagagacugagcagaauggccaucagcggcgacgacugcguggugaagccccuggacgacagauucgccagcgcccugaccgcccugaacgacaugggcaaggugagaaaggacauccagcagugggagcccagcagaggcuggaacgacuggacccaggugcccuucugcagccaccacuuccacgagcuggugaugaaggacggcagagugcugguggugcccugcagaaaccaggacgagcugaucggcagagccagaaucagccagggcgccggcuggagccugaaggagaccgccugccugggcaagagcuacgcccagauguggacccugauguacuuccacagaagagaccugagacuggccgccaacgccaucugcagcgccgugcccagccacugggugcccaccagcagaaccaccuggagcauccacgccaagcacgaguggaugaccaccgaggacaugcuggccguguggaacagaguguggauccaggagaaccccuggauggaggacaagacccccguggagagcugggaggaggugcccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugg

SEQ ID NO: 17634 - RNA, 9873 nt, Artificial Sequence
  derived and/or modified CDS sequence (opt4) from DENV-2__HQ012534__SS-prME
accgccggcgugaucaucaugcugauccccaccgccauggccuuccaccugaccaccagaaacggcgagccccacaugaucgugggcagacaggagaagggcaagagccugcuguucaagaccgaggacggcgugaacaugugcacccugauggccaucgaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgugcagagaaucgagaccuggauccugagacaccccggcuucgccaucauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaacgaggagcaggacaagagauucaucugcaagcacagcaugguggacagaggcuggggcaacggcugcggccuguucggcaagggcggcaucgugaccugcgccauguucaccugcaagaagaacauggagggcaagguggugcugcccgagaaccuggaguacaccaucgugaucaccccccacagcggcgaggagcacgccgugggcaacgacaccggcaagcacggcgaggagaucaagaucaccccccagagcagcaucaccgaggccgagcugaccggcuacggcaccgugaccauggagugcagccccagaaccggccuggacuucaacgagauggugcugcugcagauggaggagaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagaucgugaaggagaucgccgagacccagcacggcaccaucgugaucagagugcaguacgagggcgacggcagccccugcaagauccccuucgagaucauggaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcguggugacccuguaccugggcgccauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucaccaccaacaucuggcugaagcugagagagaagcaggacguguucugcgacagcaagcugaugagcgccgccaucaaggacaacagagccgugcacgccgacaugggcuacuggaucgagagcgcccugaacgacaccuggaagauggagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcaagcuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugguggccgugagcuucgugacccugaucaccggcaacaugagcuucagagaccugggcagagugauggugaugcugggcgugcccaugaccgacgacaucggcaugggcgugaccuaccuggcccugcuggccgccuucaaggugagacccaccuucgccgccggccugcugcugagaaagcugaccagcaaggagcugaugauggccaccaucggcaucgcccugcugagccagagcaccauccccgagaccauccuggagcugaccgacgcccuggcccugggcaugauggugcugaagaucgugagaaacauggagaaguaccagcuggccgugaccaucauggccaucagcugcgugcccaacgccgugauccugcugaacgccuggaaggugagcugcaccauccuggccgccgugagcgugagcccccugcugcugaccagcagccagcagaagaccgacuggaucccccuggcccugaccaucaagggccugaaccccaccgccaucuuccugaccacccugagcagaaccagcaagaagagaagcuggccccugaacgaggccgugauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggcguguuccccgugagcauccccaucaccgccgccgccugguaccugugggaggugaagaagcagagagccggcgugcugugggacgugcccagccccccccccgugggcaaggccgagcuggaggacggcgccuacagaaucaagcagagaggcauccugggcuacagccagaucggcgccggcguguacaaggagggcaccuuccacaccauguggcacgugaccagaggcgccgugcugaugcacagaggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucguggacagaaagggcaagguggugggccuguacggcaacggcguggugaccagaagcggcgccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagagccaacgacugggacuucguggugaccaccgacaucagcgagaugggcgccaacuucagagccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacagaguggccgccgagggcaucaacuacgccgacagaagauggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagagacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucaccacccaggagagcgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggagcccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccaucgaggccggcagaacccugagagugcugaaccugguggagaacuggcugaacaacaacacccaguucugcaucaaggugcugaaccccuacaugcccagcgugaucgagaagauggagacccugcagagaaaguacggcggcgcccuggugagaaacccccugagcagaaacagcacccacgagauguacugggugagcaacgccaccggcaacaucgugagcagcgugaacaugaucagcagaaugcugaucaacagauucaccaugaagcacaagaaggccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacguggugcccauggugacccagauggccaugaccgacaccacccccuucggccagcagagaguguucaaggagaagguggacaccagaacccaggagcccaaggagggcaccaagaagcugaugagaaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcagauucugggagcugguggacagagagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagaggcaacagccugagcggcguggagggcgagggccugcacagacugggcuacauccugagagacgugagcaagaaggagggcggcgccauguacgccgacgacaccgccggcugggacaccagaaucacccuggaggaccugaagaacgaggagauggugaccaaccacaugaagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcaucuucaagagcauccagcaccugaccgugaccgaggagaucgccgugcagaacuggcuggccagagugggcagagagagacugagcagaauggccaucagcggcgacgacugcguggugaagccccuggacgacagauucgccagcgcccugaccgcccugaacgacaugggcaaggugagaaaggacauccagcagugggagcccagcagaggcuggaacgacuggacccaggugcccuucugcagccaccacuuccacgagcuggugaugaaggacggcagagugcugguggugcccugcagaaaccaggacgagcugaucggcagagccagaaucagccagggcgccggcuggagccugaaggagaccgccugccugggcaagagcuacgcccagauguggacccugauguacuuccacagaagagaccugagacuggccgccaacgccaucugcagcgccgugcccagccacugggugcccaccagcagaaccaccuggagcauccacgccaagcacgaguggaugaccaccgaggacaugcuggccguguggaacagaguguggauccaggagaaccccuggauggaggacaagacccccguggagagcugggaggaggugcccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugg

SEQ ID NO: 17635 - RNA, 9873 nt, Artificial Sequence
  derived and/or modified CDS sequence (opt4) from DENV-2__HQ012535__SS-prME
accgccggcgugaucaucaugcugauccccaccgccauggccuuccaccugaccaccagaaacggcgagccccacaugaucgugggcagacaggagaagggcaagagccugcuguucaagaccgaggacggcgugaacaugugcacccugauggccaucgaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgugcagagaaucgagaccuggauccugagacaccccggcuucgccaucauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaacgaggagcaggacaagagauucaucugcaagcacagcaugguggacagaggcuggggcaacggcugcggccuguucggcaagggcggcaucgugaccugcgccauguucaccugcaagaagaacauggagggcaagguggugcugcccgagaaccuggaguacaccaucgugaucaccccccacagcggcgaggagcacgccgugggcaacgacaccggcaagcacggcgaggagaucaagaucaccccccagagcagcaucaccgaggccgagcugaccggcuacggcaccgugaccauggagugcagccccagaaccggccuggacuucaacgagauggugcugcugcagauggaggagaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagaucgugaaggagaucgccgagacccagcacggcaccaucgugaucagagugcaguacgagggcgacggcagccccugcaagauccccuucgagaucauggaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcguggugacccuguaccugggcgccauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucaccaccaacaucuggcugaagcugagagagaagcaggacguguucugcgacagcaagcugaugagcgccgccaucaaggacaacagagccgugcacgccgacaugggcuacuggaucgagagcgcccugaacgacaccuggaagauggagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcaagcuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugguggccgugagcuucgugacccugaucaccggcaacaugagcuucagagaccugggcagagugauggugauggugggcgugaccaugaccgacgacaucggcaugggcgugaccuaccuggcccugcuggccgccuucaaggugagacccaccuucgccgccggccugcugcugagaaagcugaccagcaaggagcugaugauggccaccaucggcaucgcccugcugagccagagcaccauccccgagaccauccuggagcugaccgacgcccuggcccugggcaugauggugcugaagaucgugagaaacauggagaaguaccagcuggccgugaccaucauggccaucagcugcgugcccaacgccgugauccugcugaacgccuggaaggugagcugcaccauccuggccgccgugagcgugagcccccugcugcugaccagcagccagcagaagaccgacuggaucccccuggcccugaccaucaagggccugaaccccaccgccaucuuccugaccacccugagcagaaccagcaagaagagaagcuggccccugaacgaggccgugauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggcguguuccccgugagcauccccaucaccgccgccgccugguaccugugggaggugaagaagcagagagccggcgugcugugggacgugcccagccccccccccguggagaaggccgagcuggaggacggcgccuacagaaucaagcagagaggcauccugggcuacagccagaucggcgccggcguguacaaggagggcaccuuccacaccauguggcacgugaccagaggcgccgugcugaugcacagaggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucguggacagaaagggcaagguggugggccuguacggcaacggcguggugaccagaagcggcgccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagagccaacgacugggacuucguggugaccaccgacaucagcgagaugggcgccaacuucagagccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacagaguggccgccgagggcaucaacuacgccgacagaagauggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagagacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucaccacccaggagagcgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggagcccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccaucgaggccggcagaacccugagagugcugaaccuggccgagaacuggcugaacaacaacacccaguucugcaucaaggugcugaaccccuacaugcccagcgugaucgagaagauggagacccugcagagaaaguacggcggcgcccuggugagaaacccccugagcagaaacagcacccacgagauguacugggugagcaacgccaccggcaacaucgugagcagcgugaacaugaucagcagaaugcugaucaacagauucaccaugaagcacaagaaggccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacguggugcccauggugacccagauggccaugaccgacaccacccccuucggccagcagagaguguucaaggagaagguggacaccagaacccaggagcccaaggagggcaccaagaagcugaugagaaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcagauucugggagcugguggacagagagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagaggcaacagccugagcggcguggagggcgagggccugcacagacugggcuacauccugagagacgugagcaagaaggagggcggcgccauguacgccgacgacaccgccggcugggacaccagaaucacccuggaggaccugaagaacgaggagauggugaccaaccacaugaagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcaucuucaagagcauccagcaccugaccgugaccgaggagaucgccgugcagaacuggcuggccagagugggcagagagagacugagcagaauggccaucagcggcgacgacugcguggugaagccccuggacgacagauucgccagcgcccugaccgcccugaacgacaugggcaaggugagaaaggacauccagcagugggagcccagcagaggcuggaacgacuggacccaggugcccuucugcagccaccacuuccacgagcuggugaugaaggacggcagagugcugguggugcccugcagaaaccaggacgagcugaucggcagagccagaaucagccagggcgccggcuggagccugaaggagaccgccugccugggcaagagcuacgcccagauguggacccugauguacuuccacagaagagaccugagacuggccgccaacgccaucugcagcgccgugcccagccacugggugcccaccagcagaaccaccuggagcauccacgccaagcacgaguggaugaccaccgaggacaugcuggccguguggaacagaguguggauccaggagaaccccuggauggaggacaagacccccguggagagcugggaggaggugcccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugg

SEQ ID NO: 17636 - RNA, 9873 nt, Artificial Sequence
  derived and/or modified CDS sequence (opt4) from DENV-2__HQ012536__SS-prME
accgccggcgugaucaucaugcugauccccaccgccauggccuuccaccugaccaccagaaacggcgagccccacaugaucgugggcagacaggagaagggcaagagccugcuguucaagaccgaggacggcgugaacaugugcacccugauggccaucgaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgugcagagaaucgagaccuggauccugagacaccccggcuucgccaucauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaacgaggagcaggacaagagauucaucugcaagcacagcaugguggacagaggcuggggcaacggcugcggccuguucggcaagggcggcaucgugaccugcgccauguucaccugcaagaagaacauggagggcaagguggugcugcccgagaaccuggaguacaccaucgugaucaccccccacagcggcgaggagcacgccgugggcaacgacaccggcaagcacggcaaggagaucaagaucaccccccagagcagcaucaccgaggccgagcugaccggcuacggcaccgugaccauggagugcagccccagaaccggccuggacuucaacgagauggugcugcugcagauggaggagaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagacuggacaagcugcagcugaagggcaugagcuacagcaugugcaccggcaaguucaagaucgugaaggagaucgccgagacccagcacggcaccaucgugaucagagugcaguacgagggcgacggcagccccugcaagauccccuucgagaucauggaccuggagaagagacacgugcugggcagacugaucaccgugaaccccaucgugaccggcaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcguggugacccuguaccugggcgccauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucaccaccaacaucuggcugaagcugagagagaagcaggacguguucugcgacagcaagcugaugagcgccgccaucaaggacaacagagccgugcacgccgacaugggcuacuggaucgagagcgcccugaacggcaccuggaagauggagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcaagcuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugguggccgugagcuucgugacccugaucaccggcaacaugagcuucaaggaccugggcagagugauggugauggugggcguggccaugaccgacgacaucggcaugggcgugaccuaccuggcccugcuggccgccuucaaggugagacccaccuucgccgccggccugcugcugagaaagcugaccagcaaggagcugaugauggccaccaucggcaucacccugcugagccagagcaccauccccgagaccauccuggagcugaccgacgcccuggcccugggcaugauggugcugaagaucgugagaaacauggagaaguaccagcuggccgugaccaucauggccaucagcugcgugcccaacgccgugauccugcugaacgccuggaaggugagcugcaccauccuggccgccgugagcgugagcccccugcugcugaccagcagccagcagaagaccgacuggaucccccuggcccugaccaucaagggccugaaccccaccgccaucuuccugaccacccugagcagaaccagcaagaagagaagcuggccccugaacgaggccgugauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggcguguuccccgugagcauccccaucaccgccgccgccugguaccugugggaggugaagaagcagagagccggcgugcugugggacgugcccagccccccccccgugggcaaggccgagcuggaggacggcgccuacagaaucaagcagagaggcauccugggcuacagccagaucggcgccggcguguacaaggagggcaccuuccacaccauguggcacgugaccagaggcgccgugcugaugcacagaggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucguggacagaaagggcaagguggugggccuguacggcaacggcguggugaccagaagcggcgccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagagccaacgacugggacuucguggugaccaccgacaucagcgagaugggcgccaacuucagagccgagagagugaucgaccccagaagaugcaugaagcccgugauccugaccgacggcgaggagagagugauccuggccggccccaugcccgugacccacagcagcgccgcccagagaagaggcagagugggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacagaguggccgccgagggcaucaacuacgccgacagaagauggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagagacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucaccacccaggagagcgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggagcccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccaucgaggccggcagaacccugagagugcugaaccugguggagaacuggcugaacaacaacacccaguucugcaucaaggugcugaaccccuacaugcccagcgugaucgagaagauggagacccugcagagaaaguacggcggcgcccuggugagaaacccccugagcagaaacagcacccacgagauguacugggugagcaacgccaccggcaacaucgugagcagcgugaacaugaucagcagaaugcugaucaacagauucaccaugaagcacaagaaggccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacguggugcccauggugacccagauggccaugaccgacaccacccccuucggccagcagagaguguucaaggagaagguggacaccagaacccaggagcccaaggagggcaccaagaagcugaugagaaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcagauucugggagcugguggacagagagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagaggcaacagccugagcggcguggagggcgagggccugcacagacugggcuacauccugagagacgugagcaagaaggagggcggcgccauguacgccgacgacaccgccggcugggacaccagaaucacccuggaggaccugaagaacgaggagauggugaccaaccacaugaagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcaucuucaagagcauccagcaccugaccgugaccgaggagaucgccgugcagaacuggcuggccagagugggcagagagagacugagcagaauggccaucagcggcgacgacugcguggugaagccccuggacgacagauucgccagcgcccugaccgcccugaacgacaugggcaaggugagaaaggacauccagcagugggagcccagcagaggcuggaacgacuggacccaggugcccuucugcagccaccacuuccacgagcuggugaugaaggacggcagagugcugguggugcccugcagaaaccaggacgagcugaucggcagagccagaaucagccagggcgccggcuggagccugaaggagaccgccugccugggcaagagcuacgcccagauguggacccugauguacuuccacagaagagaccugagacuggccgccaacgccaucugcagcgccgugcccagccacugggugcccaccagcagaaccaccuggagcauccacgccaagcacgaguggaugaccaccgaggacaugcuggccguguggaacagaguguggauccaggagaaccccuggaugggcgacaagacccccguggagagcugggaggaggugcccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugg

SEQ ID NO: 17637 - RNA, 9873 nt, Artificial Sequence
  derived and/or modified CDS sequence (opt4) from DENV-2__HQ012537__SS-prME
accgccggcgugaucaucaugcugauccccaccgccauggccuuccaccugaccaccagaaacggcgagccccacaugaucgugggcagacaggagaagggcaagagccugcuguucaagaccgaggacggcgugaacaugugcacccugauggccaucgaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgugcagagaaucgagaccuggauccugagacaccccggcuucgccaucauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaacgaggagcaggacaagagauucaucugcaagcacagcaugguggacagaggcuggggcaacggcugcggccuguucggcaagggcggcaucgugaccugcgccauguucaccugcaagaagaacauggagggcaagguggugcugcccgagaaccuggaguacaccaucgugaucaccccccacagcggcgaggagcacgccgugggcaacgacaccggcaagcacggcaaggagaucaagaucaccccccagagcagcaucaccgaggccgagcugaccggcuacggcaccgugaccauggagugcagccccagaaccggccuggacuucaacgagauggugcugcugcagauggaggagaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagaucgugaaggagaucgccgagacccagcacggcaccaucgugaucagagugcaguacgagggcgacggcagccccugcaagauccccuucgagaucauggaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcguggugacccuguaccugggcgccauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucaccaccaacaucuggcugaagcugagagagaagcaggacguguucugcgacagcaagcugaugagcgccgccaucaaggacaacagagccgugcacgccgacaugggcuacuggaucgagagcgcccugaacgacaccuggaagauggagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcaagcuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugguggccgugagcuucgugacccugaucaccggcaacaugagcuucagagaccugggcagagugauggugauggugggcgugaccaugaccgacgacaucggcaugggcgugaccuaccuggcccugcuggccgccuucaaggugagacccaccuucgccgccggccugcugcugagaaagcugaccagcaaggagcugaugauggccaccaucggcaucgcccugcugagccagagcaccauccccgagaccauccuggagcugaccgacgcccuggcccugggcaugauggugcugagaaucgugagaaacauggagaaguaccagcuggccgugaccaucauggccaucagcugcgugcccaacgccgugauccugcugaacgccuggaaggugagcugcaccauccuggccgccgugagcgugagcccccugcugcugaccagcagccagcagaagaccgacuggaucccccuggcccugaccaucaagggccugaaccccaccgccaucuuccugaccacccugagcagaaccagcaagaagagaagcuggccccugaacgaggccgugauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggcguguuccccgugagcauccccaucaccgccgccgccugguaccugugggaggugaagaagcagagagccggcgugcugugggacgugcccagccccccccccguggagaaggccgagcuggaggacggcgccuacagaaucaagcagagaggcauccugggcuacagccagaucggcgccggcguguacaaggagggcaccuuccacaccauguggcacgugaccagaggcgccgugcugaugcacagaggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucguggacagaaagggcaagguggugggccuguacggcaacggcguggugaccagaagcggcgccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagagccaacgacugggacuucguggugaccaccgacaucagcgagaugggcgccaacuucagagccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacagaguggccgccgagggcaucaacuacgccgacagaagauggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagagacgcccuggacaaccuggccgugcugcacaccgccgaggccggcggcagagccuacaagcacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucaccacccaggagagcgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggagcccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccaucgaggccggcagaacccugagagugcugaaccuggccgagaacuggcugaacaacaacacccaguucugcaucaaggugcugaaccccuacaugcccagcgugaucgagaagauggagacccugcagagaaaguacggcggcgcccuggugagaaacccccugagcagaaacagcacccacgagauguacugggugagcaacgccaccggcaacaucgugagcagcgugaacaugaucagcagaaugcugaucaacagauucaccaugaagcacaagaaggccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacguggugcccauggugacccagauggccaugaccgacaccacccccuucggccagcagagaguguucaaggagaagguggacaccagaacccaggagcccaaggagggcaccaagaagcugaugagaaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcagauucugggagcugguggacagagagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagaggcaacagccugagcggcguggagggcgagggccugcacagacugggcuacauccugagagacgugagcaagaaggagggcggcgccauguacgccgacgacaccgccggcugggacaccagaaucacccuggaggaccugaagaacgaggagauggugaccaaccacaugaagggcgagcacaagaagcuggccgaggccaucuucaagcugaccuaccagaacaagguggugagagugcagagacccacccccagaggcaccgugauggacaucaucagcagaaaggaccagagaggcagcggccaggugggcaccuacggccugaacaccuucaccaacauggaggcccagcugaucagacagauggagggcgagggcaucuucaagagcauccagcaccugaccgugaccgaggagaucgccgugcagaacuggcuggccagagugggcagagagagacugagcagaauggccaucagcggcgacgacugcguggugaagccccuggacgacagauucgccagcgcccugaccgcccugaacgacaugggcaaggugagaaaggacauccagcagugggagcccagcagaggcuggaacgacuggacccaggugcccuucugcagccaccacuuccacgagcuggugaugaaggacggcagagugcugguggugcccugcagaaaccaggacgagcugaucggcagagccagaaucagccagggcgccggcuggagccugaaggagaccgccugccugggcaagagcuacgcccagauguggacccugauguacuuccacagaagagaccugagacuggccgccaacgccaucugcagcgccgugcccagccacugggugcccaccagcagaaccaccuggagcauccacgccaagcacgaguggaugaccaccgaggacaugcuggccguguggaacagaguguggauccaggagaaccccuggauggaggacaagacccccguggagagcugggaggaggugcccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugg

SEQ ID NO: 17638 - RNA, 9876 nt, Artificial Sequence
  derived and/or modified CDS sequence (opt4) from DENV-2__KU365901__SS-prME
accgccggcaucaucaucaugaugauccccaccgugauggccuuccaccugaccaccagaaacggcgagccccacaugaucgugagcagacaggagaagggcaagagccugcuguucaagaccgagaacggcgugaacaugugcacccugauggccauggaccugggcgagcugugcgaggacaccaucaccuacaacugcccccugcugagacagaacgagcccgaggacaucgacugcuggugcaacagcaccagcaccugggugaccuacggcaccugcaccgccaccggcgagcacagaagagagaagagaagcguggcccuggugccccacgugggcaugggccuggagaccagaaccgagaccuggaugagcagcgagggcgccuggaagcacgcccagagaaucgagaccugggugcugagacaccccggcuucaccaucauggccgccauccuggccuacaccaucggcaccaccuacuuccagagagugcugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcaccccgccacccugagaaaguacugcaucgaggccaagcugaccaacaccaccaccgccagcagaugccccacccagggcgagcccagccugaacgaggagcaggacaagagauucgugugcaagcacagcaugguggacagaggcuggggcaacggcugcggccuguucggcaagggcggcaucgugaccugcgccauguucaccugcaagaagaacauggagggcaagaucgugcagcccgagaaccuggaguacaccaucgugaucaccccccacagcggcgaggagaacgccgugggcaacgacaccggcaagcacggcaaggagaucaaggugaccccccagagcagcaucaccgaggccgagcugaccggcuacggcaccgugaccauggagugcagccccagaaccggccuggacuucaacgagauggugcugcugcagauggagaacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucgugaucagagugcaguacgagggcgacggcagccccugcaagauccccuucgagaucauggaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugagcugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcguggugaucaccuggaucggcaugaacagcagaagcaccagccugagcgugagccuggugcuggugggcguggugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccaggagcugaaccacauccugagcgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagcugcacaaccacaccuuccugaucgacggccccgagaccgccgagugccccaacaccaacagagccuggaacagccuggagguggaggacuacggcuucggcguguucaccaccaacaucuggcugaagcugaaggagaagcaggacguguucugcgacagcaagcugaugagcgccgccaucaaggacaacagagccgugcacgccgacaugggcuacuggaucgagagcgcccugaacgacaccuggaagaucgagaaggccagcuucaucgaggugaagagcugcaacuggcccaagagccacacccuguggagcaacggcgugcuggagagcgagaugaucauccccaagaacuucgccggccccgugagccagcacaacuacagacccggcuaccacacccagaccgccggccccuggcaccugggcagacuggagauggacuucgaguucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugguggccgugaccuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugauggccaccaucggcaucgugcugcugagccagagcaccauccccgagaccauccuggagcugaccgacgcccuggcccugggcaugauggugcugaagaucgugagaaacauggagaaguaccagcuggccgugaccaucauggccauccugugcgugcccaacgccgugauccugcagaacgccuggagagugagcugcaccacccuggccguggugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugagaugggaggagcaggccgagaucagcggcagcagccccauccugagcaucaccaucagcgaggacggcagcaugagcaucaagaacgaggaggaggagcagacccugaccauccugaucagaaccggccugcuggugaucagcggccuguuccccgugagcauccccaucaccgccgccgccugguaccugugggaggugaagaagcagagagccggcgugcugugggacgugcccagccccccccccgugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacaagggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucguggacaagaagggcaagguggugggccuguacggcaacggcguggugaccagaagcggcaccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccaucagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacaucaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagagugggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacagaguggccgccgagggcaucaacuacgccgacagaagauggugcuucgacggcgugaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagaaacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggacuucggccugggcagcaucaccacccagcagcccgagagcaacauccuggacaucgaccugagacccgccagcgccuggacccuguacgccguggccaccaccuucaucacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggaccccauccccuacgaccccaaguucgagaagcagcugggccaggugaugcugcuggugcugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccgccaacaccagaagaggcaccggcaacaccggcgagacccugggcgagaaguggaagaacagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaaccuggugacccccgagggcaaggugguggaccugggcugcggcagaggcggcuggagcuacuacugcggcggccugaagaacgugaaggaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccguggaggccggcagaacccugagagugcugaaccugguggagaacuggcugaacaacaacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccagcggcaacaucgugagcagcgugaacaugaucagcagaaugcugaucaacagauucaccaugagacacaagaaggccaccuacgagcccgacguggaccugggcagcggcaccagaaacaucggcaucgagagcgagacccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacgugauccccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcagaaagaagacccccagaaugugcaccagagaggaguucaccagaaaggugagaagcaacgccgcccugggcgccaucuucaccgacgagaacaaguggaagagcgccagagaggccguggaggacagcggcuucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacauggagggcgagcacaagaagcuggccgaggccaucuucaagcugaccuaccagaacaagguggugagagugcagagacccacccccagaggcaccgugauggacaucaucagcagaagagaccagagaggcagcggccagguggugaccuacggccugaacaccuucaccaacauggaggcccagcugaucagacagauggagggcgagggcguguucaagagcauccagcagcugaccgugaccgaggagaucgccgugaagaacuggcuggccagagugggcagagagagacugagcagaauggccaucagcggcgacgacugcguggugaagccccuggacgacagauucgccagcgcccugaccgcccugaacgacaugggcaaggugagaaaggacauccagcagugggagcccagcagaggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugagagagaccgccugccugggcaagagcuacgcccagauguggagccugauguacuuccacagaagagaccugagacuggccgccaacgccaucugcagcgccgugcccagccacugggugcccaccagcagaaccaccuggagcauccacgccacccacgaguggaugaccaccgaggacaugcugaccguguggaacagaguguggauccaggagaaccccuggauggaggacaagacccccguggagagcugggaggagauccccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 17639 - RNA, 9876 nt, Artificial Sequence
  derived and/or modified CDS sequence (opt4) from DENV-2__GQ398258__SS-prME
accgccggcaugaucaucaugcugauccccaccgugauggccuuccaccugaccaccagaaacggcgagccccacaugaucgugagcagacaggagaagggcaagagccugcuguucaagaccgaggacggcgugaacaugugcacccugauggccauggaccugggcgagcugugcgaggacaccaucaccuacaacugcccccugcugagacagaacgagcccgaggacaucgacugcuggugcaacagcaccagcaccugggugaccuacggcaccugcaccgccaccggcgagcacagaagagagaagagaagcguggcccuggugccccacgugggcaugggccuggagaccagaaccgagaccuggaugagcagcgagggcgccuggaagcacgcccagagaaucgagaccuggauccugagacaccccggcuucaccaucauggccgccauccuggccuacaccaucggcaccaccuacuuccagagagugcugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgccagcagaugccccacccagggcgagcccagccugaacgaggagcaggacaagagauucgugugcaagcacagcaugguggacagaggcuggggcaacggcugcggccuguucggcaagggcggcaucgugaccugcgccauguucaccugcaagaagaacauggagggcaagguggugcagcccgagaaccuggaguacaccaucgugaucaccccccacagcggcgaggagaacgccgugggcaacgacaccggcaagcacggcaaggagaucaagaucaccccccagagcagcaucaccgaggccgagcugaccggcuacggcaccgugaccauggagugcagccccagaaccggccuggacuucaacgagauggugcugcugcagauggagaacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucgugaucagagugcaguacgagggcgacggcagccccugcaagauccccuucgagaucauggaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcguggugaucaccuggaucggcaugaacagcagaagcaccagccugagcgugagccuggugcuggugggcguggugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagcugcacaaccagaccuuccugaucgacggccccgagaccgccgagugccccaacaccaacagagccuggaacagccuggagguggaggacuacggcuucggcguguucaccaccaacaucuggcugaagcugaaggagagacaggacguguucugcgaccccaagcugaugagcgccgccaucaaggacaacagagccgugcacgccgacaugggcuacuggaucgagagcgcccugaacgacaccuggaagaucgagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcaagcuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacaagggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugaugaccaccaucggcaucgugcugcugagccagagcaccauccccgagaccauccuggagcugaccgacgcccuggcccugggcaugauggugcugaagaucgugaagaacauggagaaguaccagcuggccgugaccaucauggccauccugugcgugcccaacgccgugauccugcagaacgccuggaaggugagcugcaccauccuggccguggugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugagaugggaggaccaggccgagaucagcggcagcagccccauccugagcaucaccaucagcgaggacggcagcaugagcaucaagaacgaggaggaggagcagacccugaccauccugaucagaaccggccugcuggugaucagcggccuguuccccgugagcauccccaucaccgccgccgccugguaccugugggaggugaagaagcagagagccggcgugcugugggacgugcccagccccccccccgugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacaagggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucguggacaagaagggcaagguggugggccuguacggcaacggcguggugaccagaagcggcaccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacaucaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacagaguggccgccgagggcaucaacuacgccgacagaagauggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagaaacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggacuucggccugggcagcaucgccacccaccagcccgagagcaacauccuggacaucgaccugagacccgccagcgccuggacccuguacgccguggccaccaccuucaucacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggaccccauccccuacgaccccaaguucgagaagcagcugggccaggugaugcugcuggugcugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccgccaacaccagaagaggcaccggcaacaccggcgagacccugggcgagaaguggaagaacagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaaccuggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccguggaggccggcagaacccugagagugcugaaccugguggagaacuggcugaacaacaacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccagcggcaacaucgugagcagcgugaacaugaucagcagaaugcugaucaacagauucaccaugagacacaagaaggccaccuacgagcccgacguggaccugggcagcggcaccagaaacaucggcaucgagagcgagacccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacgugauccccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcagauucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacauggagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcguguucaagagcauccagcaccugaccgugaccgaggagaucgccgugcagaacuggcuggccagagugggcagagagagacugagcagaauggccaucagcggcgacgacugcguggugaagccccuggacgacagauucgccagcgcccugaccgcccugaacgacaugggcaaggugagaaaggacauccagcagugggagcccagcagaggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugagagagaccgccugccugggcaagagcuacgcccagauguggagccugauguacuuccacagaagagaccugagacuggccgccaacgccaucugcagcgccgugcccagccacugggugcccaccagcagaaccaccuggagcauccacgccagacacgaguggaugaccaccgaggacaugcugaccguguggaacagagugugggugcaggagaaccccuggauggaggacaagacccccguggagagcugggaggagauccccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 17640 - RNA, 9876 nt, Artificial Sequence
  derived and/or modified CDS sequence (opt4) from DENV-2__GQ398259__SS-prME
accgccggcaugaucaucaugcugauccccaccgugauggccuuccaccugaccaccagaaacggcgagccccacaugaucgugagcagacaggagaagggcaagagccugcuguucaagaccgaggacggcgugaacaugugcacccugauggccauggaccugggcgagcugugcgaggacaccaucaccuacaacugcccccugcugagacagaacgagcccgaggacaucgacugcuggugcaacagcaccagcaccugggugaccuacggcaccugcaccgccaccggcgagcacagaagagagaagagaagcguggcccuggugccccacgugggcaugggccuggagaccagaaccgagaccuggaugagcagcgagggcgccuggaagcacgcccagagaaucgagaccuggauccugagacaccccggcuucaccaucauggccgccauccuggccuacaccaucggcaccaccuacuuccagagagugcugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgccagcagaugccccacccagggcgagcccagccugaacgaggagcaggacaagagauucgugugcaagcacagcaugguggacagaggcuggggcaacggcugcggccuguucggcaagggcggcaucgugaccugcgccauguucaccugcaagaagaacauggagggcaagguggugcagcccgagaaccuggaguacaccaucgugaucaccccccacagcggcgaggagaacgccgugggcaacgacaccggcaagcacggcaaggagaucaagaucaccccccagagcagcaucaccgaggccgagcugaccggcuacggcaccgugaccauggagugcagccccagaaccggccuggacuucaacgagauggugcugcugcagauggagaacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucgugaucagagugcaguacgagggcgacggcagccccugcaagauccccuucgagaucauggaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcguggugaucaccuggaucggcaugaacagcagaagcaccagccugagcgugagccuggugcuggugggcguggugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagcugcacaaccagaccuuccugaucgacggccccgagaccgccgagugccccaacaccaacagagccuggaacagccuggagguggaggacuacggcuucggcguguucaccaccaacaucuggcugaagcugaaggagagacaggacguguucugcgacagcaagcugaugagcgccgccaucaaggacaacagagccgugcacgccgacaugggcuacuggaucgagagcgcccugaacgacaccuggaagaucgagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcaagcuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacaagggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugaugaccaccaucggcaucgugcugcugagccagagcaccauccccgagaccauccuggagcugaccgacgcccuggcccugggcaugauggugcugaagaucgugaagaacauggagaaguaccagcuggccgugaccaucauggccauccugugcgugcccaacgccgugauccugcagaacgccuggaaggugagcugcaccauccuggccguggugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugagaugggaggaccaggccgagaucagcggcagcagccccauccugagcaucaccaucagcgaggacggcagcaugagcaucaagaacgaggaggaggagcagacccugaccauccugaucagaaccggccugcuggugaucagcggccuguuccccgugagcauccccaucaccgccgccgccugguaccugugggaggugaagaagcagagagccggcgugcugugggacgugcccagccccccccccgugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacaagggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucguggacaagaagggcaagguggugggccuguacggcaacggcguggugaccagaagcggcaccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacaucaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacagaguggccgccgagggcaucaacuacgccgacagaagauggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagaaacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggacuucggccugggcagcaucgccacccaccagcccgagagcaacauccuggacaucgaccugagacccgccagcgccuggacccuguacgccguggccaccaccuucaucacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggaccccauccccuacgaccccaaguucgagaagcagcugggccaggugaugcugcuggugcugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccgccaacaccagaagaggcaccggcaacaccggcgagacccugggcgagaaguggaagaacagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaaccuggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccguggaggccggcagaacccugagagugcugaaccugguggagaacuggcugaacaacaacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccagcggcaacaucgugagcagcgugaacaugaucagcagaaugcugaucaacagauucaccaugagacacaagaaggccaccuacgagcccgacguggaccugggcagcggcaccagaaacaucggcaucgagagcgagacccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacgugauccccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcagauucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacauggagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcguguucaagagcauccagcaccugaccgugaccgaggagaucgccgugcagaacuggcuggccagagugggcagagagagacugagcagaauggccaucagcggcgacgacugcguggugaagccccuggacgacagauucgccagcgcccugaccgcccugaacgacaugggcaaggugagaaaggacauccagcagugggagcccagcagaggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugagagagaccgccugccugggcaagagcuacgcccagauguggagccugauguacuuccacagaagagaccugagacuggccgccaacgccaucugcagcgccgugcccagccacugggugcccaccagcagaaccaccuggagcauccacgccagacacgaguggaugaccaccgaggacaugcugaccguguggaacagagugugggugcaggagaaccccuggauggaggacaagacccccguggagagcugggaggagauccccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 17641 - RNA, 9876 nt, Artificial Sequence
  derived and/or modified CDS sequence (opt4) from DENV-2__GQ398268__SS-prME
accgccggcaugaucaucaugcugauccccaccgugauggccuuccaccugaccaccagaaacggcgagccccacaugaucgugagcagacaggagaagggcaagagccugcuguucaagaccgaggacggcgugaacaugugcacccugauggccauggaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgcccagagaaucgagaccuggauccugagacaccccggcuucaccaucauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaacgaggagcaggacaagagauucgugugcaagcacagcaugguggacagaggcuggggcaacggcugcggccuguucggcaagggcggcaucgugaccugcgccauguucaccugcaagaagaacauggagggcaagguggugcagcccgagaaccuggaguacaccaucgugaucaccccccacagcggcgaggagcacgccgugggcaacgacaccggcaagcacggcaaggagaucaagaucaccccccagagcagcaucaccgaggccgagcugaccggcuacggcaccgugaccauggagugcagccccagaaccggccuggacuucaacgagauggugcugcugcagauggagaacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucgugaucagagugcaguacgagggcgacggcagccccugcaagauccccuucgagaucauggaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcguggugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucaccaccaacaucuggcugaagcugagagagaagcaggacguguucugcgacagcaagcugaugagcgccgccaucaaggacaacagagccgugcacgccgacaugggcuacuggaucgagagcgcccugaacgacaccuggaagaucgagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcaagcuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugaugaccaccaucggcaucgugcugcugagccagagcaccauccccgagaccauccuggagcugaccgacgcccuggcccugggcaugauggugcugaagauggugagaaagauggagaaguaccagcuggccgugaccaucauggccauccugugcgugcccaacgccgugauccugcagaacgccuggaaggugagcugcaccauccuggccguggugagcgugagcccccugcugcugaccagcagccagcagaaggccgacuggaucccccuggcccugaccaucaagggccugaaccccaccgccaucuuccugaccacccugagcagaaccaacaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggccuguuccccgugagcauccccaucaccgccgccgccugguaccugugggaggugaagaagcagagagccggcgugcugugggacgugcccagccccccccccgugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacaagggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacgccggcaccaucggcgccgugagccuggacuucagccccggcaccagcggcagccccaucaucgacaagaagggcaagguggugggccuguacggcaacggcguggugaccagaagcggcgccuacgugagcgccaucgcccagaccgagaagagcaucgaggacaaccccgagaucgaggacgacaucuucagaaagagaaagcugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggagcagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacagaguggccgccgagggcaucaacuacgccgacagaagauggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagagacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcagaggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucaccacccagcagcccgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggaccccauccccuacgaccccaaguucgagaagcagcugggccaggugaugcugcuggugcugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccguggaggccggcagaacccugagagugcugaaccugguggagaacuggcugaacaacaacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccagcggcaacaucgugagcagcgugaacaugaucagcagaaugcugaucaacagauucaccaugagacacaagaaggccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacguggugcccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcagauucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacauggagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcguguucaagagcauccagcaccugaccgugaccgaggagaucgccgugcagaacuggcuggccagagugggcagagagagacugagcagaauggccaucagcggcgacgacugcguggugaagccccuggacgacagauucgccagcgcccugaccgcccugaacgacaugggcaaggugagaaaggacauccagcagugggagcccagcagaggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugagagagaccgccugccugggcaagagcuacgcccagauguggagccugauguacuuccacagaagagaccugagacuggccgccaacgccaucugcagcgccgugcccagccacugggugcccaccagcagaaccaccuggagcauccacgccaagcacgaguggaugaccaccgaggacaugcugaccguguggaacagaguguggauccaggagaaccccuggauggaggacaagacccccguggagagcugggaggagauccccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 17642 - RNA, 9876 nt, Artificial Sequence
  derived and/or modified CDS sequence (opt4) from DENV-2__GQ398263__SS-prME
accgccggcaugaucaucaugaugauccccaccgugauggccuuccaccugaccaccagaaacggcgagccccacaugaucgugagcagacaggagaagggcaagagccugcuguucaagaccgaggacggcgugaacaugugcacccugauggccauggaccugggcgagcugugcgaggacaccaucaccuacaacugcccccugcugagacagaacgagcccgaggacaucgacugcuggugcaacagcaccagcaccugggugaccuacggcaccugcaccgccaccggcgagcacagaagagagaagagaagcguggcccuggugccccacgugggcaugggccuggagaccagaaccgagaccuggaugagcagcgagggcgccuggaagcacgcccagagaaucgagaccugggugcugagacaccccggcuucaccaucauggccgccauccuggccuacaccaucggcaccaccuacuuccagagagugcugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcaccccgccacccugagaaaguacugcaucgaggccaagcugaccaacaccaccaccgccagcagaugccccacccagggcgagcccagccugaacgaggagcaggacaagagauucgugugcaagcacagcaugguggacagaggcuggggcaacggcugcggccuguucggcaagggcggcaucgugaccugcgccauguucaccugcaagaagaacauggagggcaagguggugcagcccgagaaccuggaguacaccaucgugaucaccccccacagcggcgaggagaacgccgugggcaacgacaccggcaagcacggcaaggagaucaagaucaccccccagagcagcaucaccgaggccgagcugaccggcuacggcaccgugaccauggagugcagccccagaaccggccuggacuucaacgagauggugcugcugcagauggagaacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucguggugagagugcaguacgagggcgacggcagccccugcaagauccccuucgagaucauggaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugagcugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcguggugaucaccuggaucggcaugaacagcagaagcaccagccugagcgugagccuggugcuggugggcguggugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagcugcacaaccacaccuuccugaucgacggccccgagaccgccgagugccccaccaccaacagagccuggaacagccuggagguggaggacuacggcuucggcguguucaccaccaacaucuggcugaagcugaaggagagacaggacgugcugugcgacagcaagcugaugagcgccgccaucaaggacaacagagccgugcacgccgacaugggcuacuggaucgagagcgcccugaacgacaccuggaagaucgagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcaagcuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggacaaggaggagaaccuggugaacagccuggugaccgccggccacggccagaucgacaacuucagccugggcgugcugggcauggcccuguuccuggaggagaugcugagaaccagagugggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugaugaccaccaucggcaucgugcugcugagccagagcaccauccccgagaccauccuggagcugaccgacgcccuggcccugggcaugauggugcugaagaucgugagaaacauggagaaguaccagcuggccgugaccaucauggccauccugugcgugcccaacgccgugauccugcagaacgccuggaaggugagcugcaccauccuggccguggugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugagaugggaggaccaggccgagaucagcggcagcagccccauccugagcaucaccaucagcgaggacggcagcaugagcaucaagaacgaggaggaggagcagacccugaccauccugaucagaaccggccugcuggugaucagcggccuguuccccgugagcauccccaucaccgccgccgccugguaccugugggaggugaagaagcagagagccggcgugcugugggacgugcccagccccccccccgugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacaagggcaagagaaucgagcccagcugggccgacgugagaaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucguggacaagaagggcaagguggugggccuguacggcaacggcguggugaccagaagcggcaccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacaucaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacagaguggccgccgagggcaucaacuacgccgacagaagauggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagaaacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggacuucggccugggcagcaucgccacccagcagcccgagagcaacauccuggacaucgaccugagacccgccagcgccuggacccuguacgccguggccaccaccuucaucacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggaccccauccccuacgaccccaaguucgagaagcagcugggccaggugaugcugcuggugcugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccgccaacaccagaagaggcaccggcaacaccggcgagacccugggcgagaaguggaagaacagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaaccuggugacccccgagggcaaggugguggaccugggcugcggcagaggcggcuggagcuacuacugcggcggccugaagaacgugaaggaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccguggaggccggcagaacccugagagugcugaaccugguggagaacuggcugaacaacaacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccagcggcaacaucgugagcagcgugaacaugaucagcagaaugcugaucaacagauucaccaugagacacaagaaggccaccuacgagcccgacguggaccugggcagcggcaccagaaacaucggcaucgagagcgagauccccaaccuggacgugaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacgugauccccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuacaccgacgagaacaaguggaagagcgccagagaggccguggaggacagcagauucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacauggagggcgagcacaagaagcuggccgaggccaucuucaagcugaccuaccagaacaagguggugagagugcagagacccacccccagaggcaccgugauggacaucaucagcagaagagaccagagaggcagcggccagguggugaccuacggccugaacaccuucaccaacauggaggcccagcugaucagacagauggagggcgagggcguguucaagagcauccagcaccugaccgugaccgaggagaucgccgugaagaacuggcuggccagagugggcagagagagacugagcagaauggccaucagcggcgacgacugcguggugaagccccuggacgacagauucgccagcgcccugaccgcccugaacgacaugggcaaggugagaaaggacauccagcagugggagcccagcagaggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugagagagaccgccugccugggcaagagcuacgcccagauguggagccugauguacuuccacagaagagaccugagacuggccgccaacgccaucugcagcgccgugcccagccacugggugcccaccagcagaaccaccuggagcauccacgccacccacgaguggaugaccaccgaggacaugcugaccguguggaacagaguguggauccaggagaaccccuggauggaggacaagacccccguggagagcugggaggagauccccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 17643 - RNA, 9876 nt, Artificial Sequence
  derived and/or modified CDS sequence (opt4) from DENV-2__GQ398264__SS-prME
accgccggcaugaucaucaugaugauccccaccgugauggccuuccaccugaccaccagaaacggcgagccccacaugaucgugagcagacaggagaagggcaagagccugcuguucaagaccgagaacggcgugaacaugugcacccugauggccauggaccugggcgagcugugcgaggacaccaucaccuacaacugcccccugcugagacagaacgagcccgaggacaucgacugcuggugcaacagcaccagcaccugggugaccuacggcaccugcaccgccaccggcgagcacagaagagagaagagaagcguggcccuggugccccacgugggcaugggccuggagaccagaaccgagaccuggaugagcagcgagggcgccuggaagcacgcccagagaaucgagaccugggugcugagacaccccggcuucaccaucauggccgccauccuggccuacaccaucggcaccaccuacuuccagagagugcugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcaccccgccacccugagaaaguacugcaucgaggccaagcugaccaacaccaccaccgccagcagaugccccacccagggcgagcccagccugaacgaggagcaggacaagagauucgugugcaagcacagcaugguggacagaggcuggggcaacggcugcggccuguucggcaagggcggcaucgugaccugcgccauguucaccugcaagaagaacauggagggcaagguggugcagcccgagaaccuggaguacaccaucgugaucaccccccacagcggcgaggagaacgccgugggcaacgacaccggcaagcacggcaaggagaucaagaucaccccccagagcagcaucaccgaggccgagcugaccggcuacggcaccgugaccauggagugcagccccagaaccggccuggacuucaacgagauggugcugcugcagauggagaacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucgugaucagagugcaguacgagggcgacggcagccccugcaagauccccuucgagaucauggaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugagcugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcguggugaucaccuggaucggcaugaacagcagaagcaccagccugagcgugagccuggugcuggugggcguggugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagcugcacaaccacaccuuccugaucgacggccccgagaccgccgagugccccaacaccaacagagccuggaacagccuggagguggaggacuacggcuucggcguguucaccaccaacaucuggcugaagcugaaggagagacaggacguguucugcgacagcaagcugaugagcgccgccaucaaggacaacagagccgugcacgccgacaugggcuacuggaucgagagcgcccugaacgacaccuggaugaucgagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcagcugggcaagcuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugaugaccaccaucggcaucgugcugcugagccagagcaccauccccgagaccauccuggagcugaccgacgcccuggcccugggcaugauggugcugaagaucgugagaaacauggagaaguaccagcuggccgugaccaucauggccauccugugcgugcccaacgccgugauccugcagaacgccuggaaggugagcugcaccacccuggccguggugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugagaugggaggaccaggccgagaucagcggcagcagccccauccugagcaucaccaucagcgaggacggcagcaugagcaucaagaacgaggaggaggagcagacccugaccauccugaucagaaccggccugcuggugaucagcggccuguuccccgugagcauccccaucaccgccgccgccugguaccugugggaggugaagaagcagagagccggcgugcugugggacgugcccagccccccccccgugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacaagggcaagagaaucgagcccagcugggccgacgugagaaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucguggacaagaagggcaagguggugggccuguacggcaacggcguggugaccagaagcggcaccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacaucaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagagugggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacagaguggccgccgagggcaucaacuacgccgacagaagauggugcuucgacggcgugaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagaaacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggacuucggccugggcagcaccgccacccagcagcccgagagcaacauccuggacaucgaccugagacccgccagcgccuggacccuguacgccguggccaccaccuucaucacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggaccccauccccuacgaccccaaguucgagaagcagcugggccaggugaugcugcuggugcugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccgccaacaccagaagaggcaccggcaacaccggcgagacccugggcgagaaguggaagaacagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaaccuggugacccccgagggcaaggugguggaccugggcugcggcagaggcggcuggagcuacuacugcggcggccugaagaacgugaaggaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccguggaggccggcagaacccugagagugcugaaccugguggagaacuggcugaacaacaacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccagcggcaacaucgugagcagcgugaacaugaucagcagaaugcugaucaacagauucaccaugagacacaagaaggccaccuacgagcccgacguggaccugggcagcggcaccagaaacaucggcaucgagagcgagacccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacgugauccccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcggcuucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacauggagggcgagcacaagaagcuggccgaggccaucuucaagcugaccuaccagaacaagguggugagagugcagagacccacccccagaggcaccgugauggacaucaucagcagaagagaccagagaggcagcggccagguggugaccuacggccugaacaccuucaccaacauggaggcccagcugaucagacagauggagggcgagggcguguucaagagcauccagcaccugaccgugaccgaggagaucgccgugaagaacuggcuggccagagugggcagagagagacugagcagaauggccaucagcggcgacgacugcguggugaagccccuggacgacagauucgccagcgcccugaccgcccugaacgacaugggcaaggugagaaaggacauccagcagugggagcccagcagaggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugagagagaccgccugccugggcaagagcuacgcccagauguggagccugauguacuuccacagaagagaccugagacuggccgccaacgccaucugcagcgccgugcccagccacugggugcccaccagcagaaccaccuggagcauccacgccacccacgaguggaugaccaccgaggacaugcugaccguguggaacagaguguggauccaggagaaccccuggauggaggacaagacccccguggagagcugggaggagauccccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 17644 - RNA, 9876 nt, Artificial Sequence
  derived and/or modified CDS sequence (opt4) from DENV-2__GQ398260__SS-prME
accgccggcaugaucaucaugcugauccccaccgugauggccuuccaccugaccaccagaaacggcgagccccacaugaucgugagcagacaggagaagggcaagagccugcuguucaagaccgaggacggcgugaacaugugcacccugauggccauggaccugggcgagcugugcgaggacaccaucaccuacaacugcccccugcugagacagaacgagcccgaggacaucgacugcuggugcaacagcaccagcaccugggugaccuacggcaccugcaccgccaccggcgagcacagaagagagaagagaagcguggcccuggugccccacgugggcaugggccuggagaccagaaccgagaccuggaugagcagcgagggcgccuggaagcacgcccagagaaucgagaccuggauccugagacaccccggcuucaccaucauggccgccauccuggccuacaccaucggcaccaccuacuuccagagagugcugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgccagcagaugccccacccagggcgagcccagccugaacgaggagcaggacaagagauucgugugcaagcacagcaugguggacagaggcuggggcaacggcugcggccuguucggcaagggcggcaucgugaccugcgccauguucaccugcaagaagaacauggagggcaagguggugcagcccgagaaccuggaguacaccaucgugaucaccccccacagcggcgaggagaacgccgugggcaacgacaccggcaagcacggcaaggagaucaagaucaccccccagagcagcaucaccgaggccgagcugaucggcuacggcaccgugaccauggagugcagccccagaaccggccuggacuucaacgagauggugcugcugcagauggagaacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucgugaucagagugcaguacgagggcgacggcagccccugcaagauccccuucgagaucauggaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcguggugaucaccuggaucggcaugaacagcagaagcaccagccugagcgugagccuggugcuggugggcguggugacccuguaccugggcgugauggugcaggccgacagcggcugcguggugagcuggaagaacaaggagcugaagugcggcagcggcaucuucgugaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagcugcacaaccagaccuuccugaucgacggccccgagaccgccgagugccccaacaccaacagagccuggaacagccuggagguggaggacuacggcuucggcguguucaccaccaacaucuggcugaagcugaaggagagacaggacguguucugcgacagcaagcugaugagcgccgccaucaaggacaacagagccgugcacgccgacaugggcuacuggaucgagagcgcccugaacgacaccuggaagaucgagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcaagcuggagauggacuucaacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugaugaccaccaucggcaucgugcugcugagccagagcaccauccccgagaccauccuggagcugaccgacgcccuggcccugggcaugauggugcugaagaucgugagaaacauggagaaguaccagcuggccgugaccaucauggccauccugugcgugcccaacgccgugauccugcagaacgccuggaaggugagcugcaccauccuggccguggugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugagaugggaggaccaggccgagaucagcggcagcagccccauccugagcaucaccaucagcgaggacggcagcaugagcaucaagaacgaggaggaggagcagacccugaccauccugaucagaaccggccugcuggugaucagcggccuguuccccgugagcauccccaucaccgccgccgccugguaccugugggaggugaagaagcagagagccggcgugcugugggacgugcccagccccccccccgugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacaagggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucguggacaagaagggcaagguggugggccuguacggcaacggcguggugaccagaagcggcaccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacaucaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacagaguggccgccgagggcaucaacuacgccgacagaagauggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaucggcagacugcccaccuucaugacccagaaggccagaaacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggacuucggccugggcagcaucgccacccagcagcccgagagcaacauccuggacaucgaccugagacccgccagcgccuggacccuguacgccguggccaccaccuucaucacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggaccccauccccuacgaccccaaguucgagaagcagcugggccaggugaugcugcuggugcugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccgccaacaccagaagaggcaccggcaacaccggcgagacccugggcgagaaguggaagaacagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaaccuggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccaucgaggccggcagaacccugagagugcugaaccugguggagaacuggcugaacaacaacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccagcggcaacaucgugagcagcgugaacaugaucagcagaaugcugaucaacagauucaccaugagacacaagaaggccaccuacgagcccgacguggaccugggcagcggcaccagaaacaucggcaucgagagcgagacccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacgugauccccaccgugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcagauucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacauggagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcguguucaagagcauccagcaccugaccgugaccgaggagaucgccgugcagaacuggcuggccagagugggcagagagagacugagcagaauggccaucagcggcgacgacugcguggugaagccccuggacgacagauucgccagcgcccugaccgcccugaacgacaugggcaaggugagaaaggacauccagcagugggagcccagcagaggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugagagagaccgccugccugggcaagagcuacgcccagauguggagccugauguacuuccacagaagagaccugagacuggccgccaacgccaucugcagcgccgugcccagccacugggugcccaccagcagaaccaccuggagcauccacgccagacacgaguggaugaccaccgaggacaugcugaccguguggaacagaguguggauccaggagaaccccuggauggaggacaagacccccguggagagcugggaggagauccccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 17645 - RNA, 9876 nt, Artificial Sequence
  derived and/or modified CDS sequence (opt4) from DENV-2__GQ398262__SS-prME
accgccggcaugaucaucaugcugauccccaccgugauggccuuccaccugaccaccagaaacggcgagccccacaugaucgugagcagacaggagaagggcaagagccugcuguucaagaccgaggacggcgugaacaugugcacccugauggccauggaccugggcgagcugugcgaggacaccaucaccuacaacugcccccugcugagacagaacgagcccgaggacaucgacugcuggugcaacagcaccagcaccugggugaccuacggcaccugcaccgccaccggcgagcacagaagagagaagagaagcguggcccuggugccccacgugggcaugggccuggagaccagaaccgagaccuggaugagcagcgagggcgccuggaagcacgcccagagaaucgagaccuggauccugagacaccccggcuucaccaucauggccgccauccuggccuacaccaucggcaccaccuacuuccagagagugcugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgccagcagaugccccacccagggcgagcccagccugaacgaggagcaggacaagagauucgugugcaagcacagcaugguggacagaggcuggggcaacggcugcggccuguucggcaagggcggcaucgugaccugcgccauguucaccugcaagaagaacauggagggcaagguggugcagcccgagaaccuggaguacaccaucgugaucaccccccacagcggcgaggagaacgccgugggcaacgacaccggcaagcacggcaaggagaucaagaucaccccccagagcagcaucaccgaggccgagcugaccggcuacggcaccgugaccauggagugcagccccagaaccggccuggacuucaacgagauggugcugcugcagauggagaacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucgugaucagagugcaguacgagggcgacggcagccccugcaagauccccuucgagaucauggaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcguggugaucaccuggaucggcaugaacagcagaagcaccagccugagcgugagccuggugcuggugggcguggugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugagacugaccaucaugaccggcgacaucaagggcaucaugcaggccggcaagagaagccugagaccccagcccaccgagcugaaguacagcuggaagaccuggggcaaggccaagaugcugagcaccgagcugcacaaccagaccuuccugaucgacggccccgagaccgccgagugccccaacaccaacagagccuggaacagccuggagguggaggacuacggcuucggcguguucaccaccaacaucuggcugaagcugaaggagagacaggacguguucugcgacagcaagcugaugagcgccgccaucaaggacaacagagccgugcacgccgacaugggcuacuggaucgagagcgcccugaacgacaccuggaagaucgagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcaagcuggagauggacuucaacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugaugaccaccaucggcaucgugcugcugagccagagcaccauccccgagaccauccuggagcugaccgacgcccuggcccugggcaugauggugcugaagaucgugagaaacauggagaaguaccagcuggccgugaccaucauggccauccugugcgugcccaacgccgugauccugcagaacgccuggaaggugagcugcaccauccuggccguggugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugagaugggaggaccaggccgagaucagcggcagcagccccauccugagcaucaccaucagcgaggacggcagcaugagcaucaagaacgaggaggaggagcagacccugaccauccugaucagaaccggccugcuggugaucagcggccuguuccccgugagcauccccaucaccgccgccgccugguaccugugggaggugaagaagcagagagccggcgugcugugggacgugcccagccccccccccgugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacaagggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucguggacaagaagggcaagguggugggccuguacggcaacggcguggugaccagaagcggcaccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacaucaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacagaguggccgccgagggcaucaacuacgccgacagaagauggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagaaacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggacuucggccugggcagcaucgccacccagcagcccgagagcaacauccuggacaucgaccugagacccgccagcgccuggacccuguacgccguggccaccaccuucaucacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggaccccauccccuacgaccccaaguucgagaagcagcugggccaggugaugcugcuggugcugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccgccaacaccagaagaggcaccggcaacaccggcgagacccugggcgagaaguggaagaacagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaaccuggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccguggaggccggcagaacccugagagugcugaaccugguggagaacuggcugaacaacaacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccagcggcaacaucgugagcagcgugaacaugaucagcagaaugcugaucaacagauucaccaugagacacaagaaggccaccuacgagcccgacguggaccugggcagcggcaccagaaacaucggcaucgagagcgagacccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacgugauccccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcagauucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacauggagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcguguucaagagcauccagcaccugaccgugaccgaggagaucgccgugcagaacuggcuggccagagugggcagagagagacugagcagaauggccaucagcggcgacgacugcguggugaagccccuggacgacagauucgccagcgcccugaccgcccugaacgacaugggcaaggugagaaaggacauccagcagugggagcccagcagaggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugagagagaccgccugccugggcaagagcuacgcccagauguggagccugauguacuuccacagaagagaccugagacuggccgccaacgccaucugcagcgccgugcccagccacugggugcccaccagcagaaccaccuggagcauccacgccagacacgaguggaugaccaccgaggacaugcugaccguguggaacagaguguggauccaggagaaccccuggauggaggacaagacccccguggagagcugggaggagauccccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 17646 - RNA, 9876 nt, Artificial Sequence
  derived and/or modified CDS sequence (opt4) from DENV-2__GQ398261__SS-prME
accgccggcaugaucaucaugcugauccccaccgugauggccuuccaccugaccaccagaaacggcgagccccacaugaucgugagcagacaggagaagggcaagagccugcuguucaagaccgaggacggcgugaacaugugcacccugauggccauggaccugggcgagcugugcgaggacaccaucaccuacaacugcccccugcugagacagaacgagcccgaggacaucgacugcuggugcaacagcaccagcaccuggaucaccuacggcaccugcaccgccaccggcgagcacagaagagagaagagaagcguggcccuggugccccacgugggcaugggccuggagaccagaaccgagaccuggaugagcagcgagggcgccuggaagcacgcccagagaaucgagaccuggauccugagacaccccggcuucaccaucauggccgccauccuggccuacaccaucggcaccaccuacuuccagagagugcugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgccagcagaugccccacccagggcgagcccagccugaacgaggagcaggacaagagauucgugugcaagcacagcaugguggacagaggcuggggcaacggcugcggccuguucggcaagggcggcaucgugaccugcgccauguucaccugcaagaagaacauggagggcaagguggugcagcccgagaaccuggaguacaccaucgugaucaccccccacagcggcgaggagaacgccgugggcaacgacaccggcaagcacggcaaggagaucaagaucaccccccagagcagcaucaccgaggccgagcugaccggcuacggcaccgugaccauggagugcagccccagaaccggccuggacuucaacgagauggugcugcugcagauggagaacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucguggugagagugcaguacgagggcgacggcagccccugcaagauccccuucgagaucauggaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcguggugaucaccuggaucggcaugaacagcagaagcaccagccugagcgugagccuggugcuggugggcguggugacccuguaccugggcgugauggugcaggccgacagcggcugcguggugagcuggaagaacaaggagcugaagugcggcagcggcaucuucgugaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagcugcacaaccagaccuuccugaucgacggccccgagaccgccgagugccccaacaccaacagagccuggaacagccuggagguggaggacuacggcuucggcguguucaccaccaacaucuggcugaagcugaaggagagacaggacguguucugcgacagcaagcugaugagcgccgccaucaaggacaacagagccgugcacgccgacaugggcuacuggaucgagagcgcccugaacgacaccuggaagaucgagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcaagcuggagauggacuucaacuucugcgagggcaccaccgugguggugaccggcgacugcggcaacagaggccccgcccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugaugaccaccaucggcaucgugcugcugagccagagcaccauccccgagaccauccuggagcugaccgacgcccuggcccugggcaugauggugcugaagaucgugagaaacauggagaaguaccagcuggccgugaccaucauggccauccugugcgugcccaacgccgugauccugcagaacgccuggaaggugagcugcaccauccuggccguggugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugagaugggaggaccaggccgagaucagcggcagcagccccauccugagcaucaccaucagcgaggacggcagcaugagcaucaagaacgaggaggaggagcagacccugaccauccugaucagaaccggccugcuggugaucagcggccuguuccccgugagcauccccaucaccgccgccgccugguaccugugggaggugaagaagcagagagccggcgugcugugggacgugcccagccccccccccgugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacaagggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucguggacaagaagggcaagguggugggccuguacggcaacggcguggugaccagaagcggcaccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacaucaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacagaguggccgccgagggcaucaacuacgccgacagaagauggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaucggcagacugcccaccuucaugacccagaaggccagaaacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggacuucggccugggcagcaucgccacccagcagcccgagagcaacauccuggacaucgaccugagacccgccagcgccuggacccuguacgccguggccaccaccuucaucacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggaccccauccccuacgaccccaaguucgagaagcagcugggccaggugaugcugcuggugcugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccgccaacaccagaagaggcaccggcaacaccggcgagacccugggcgagaaguggaagaacagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaaccuggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccaucgaggccggcagaacccugagagugcugaaccugguggagaacuggcugaacaacaacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccagcggcaacaucgugagcagcgugaacaugaucagcagaaugcugaucaacagauucaccaugagacacaagaaggccaccuacgagcccgacguggaccugggcagcggcaccagaaacaucggcaucgagagcgagacccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacgugauccccaccgugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcagauucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacauggagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcguguucaagagcauccagcaccugaccgugaccgaggagaucgccgugcagaacuggcuggccagagugggcagagagagacugagcagaauggccaucagcggcgacgacugcguggugaagccccuggacgacagauucgccagcgcccugaccgcccugaacgacaugggcaaggugagaaaggacauccagcagugggagcccagcagaggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugagagagaccgccugccugggcaagagcuacgcccagauguggagccugauguacuuccacagaagagaccugagacuggccgccaacgccaucugcagcgccgugcccagccacugggugcccaccagcagaaccaccuggagcauccacgccagacacgaguggaugaccaccgaggacaugcugaccguguggaacagaguguggauccaggagaaccccuggauggaggacaagacccccguggagagcugggaggagauccccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 17647 - RNA, 9876 nt, Artificial Sequence
  derived and/or modified CDS sequence (opt4) from DENV-2__GQ398313__SS-prME
accgccggcgugaucaucaugcugauccccaccgccauggccuuccaccugaccaccagaaacggcgagccccacaugaucgugggcagacaggagaagggcaagagccugcuguucaagaccgaggacggcgugaacaugugcacccugauggccaucgaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgugcagagaaucgagaccuggauccugagacaccccggcuucaccaucauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaacgaggagcaggacaagagauucgugugcaagcacagcaugguggacagaggcuggggcaacggcugcggccuguucggcaagggcggcaucgugaccugcgccauguucaccugcaagaagaacauggagggcaagguggugcugcccgagaaccuggaguacaccaucgugaucaccccccacagcggcgaggagcacgccgugggcaacgacaccggcaagcacggcaaggagaucaagaucaccccccagagcagcaucaccgaggccgagcugaccggcuacggcaccgugaccauggagugcagccccagaaccggccuggacuucaacgagauggugcugcugcagauggaggacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagaucgugaaggagaucgccgagacccagcacggcaccaucgugaucagagugcaguacgagggcgacggcagccccugcaagauccccuucgagaucauggaccuggagaagagacacgugcugggcagacugaucaccgugaaccccaucguggccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcguggugacccuguaccugggcgccauggugcaggccgacagcggcugcguggugagcuggaagagcaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucaccaccaacaucuggcugaagcugagagagaagcaggacguguucugcgacagcaagcugaugagcgccgccaucaaggacaacagagccgugcacgccgacaugggcuacuggaucgagagcgcccugaacgacaccuggaagauggagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcaagcuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccaugcugcugguggccgugagcuucgugacccugaucaccggcaacaugagcuucagagaccugggcagagugauggugauggugggcgccaccaugaccgacgacaucggcaugggcaucaccuaccuggcccugcuggccgccuucaaggugagacccaccuucgccgccggccugcugcugagaaagcugaccagcaaggagcugaugauggccaccaucggcaucgcccugcugagccagagcaccauccccgagaccauccuggagcugaccgacgcccuggcccugggcaugauggugcugaagaucgugagaaacauggagaaguaccagcuggccgugaccaucauggccaucagcugcgugcccaacgccgugauccugcagaacgccuggaaggugagcugcaccauccuggccgccgugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccgugauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggcguguuccccgugagcauccccaucaccgccgccgccugguaccugugggaggugaagaagcagagagccggcgugcugugggacgugcccagccccccccccgugggcaaggccgagcuggaggacggcgccuacagaaucaagcagagaggcauccugggcuacagccagaucggcgccggcguguacaaggagggcaccuuccacaccauguggcacgugaccagaggcgccgugcugaugcacagaggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucguggacagaaagggcaagguggugggccuguacggcaacggcguggugaccagaagcggcgccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagagccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacagaguggccgccgagggcaucaacuacgccgacagaagauggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagagacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucgccacccaggagagcgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggagcccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccaucgaggccggcagaacccugagagugcugaaccugguggagaacuggcugaacaacaacacccaguucugcaucaaggugcugaaccccuacaugcccagcgugaucgagaagauggagacccugcagagaaaguacggcggcgcccuggugagaaacccccugagcagaaacagcacccacgagauguacugggugagcaacgccaccggcaacaucgugagcagcgugaacaugaucagcagaaugcugaucaacagauucaccaugaagcacaagaaggccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacguggugcccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcagauucugggagcugaucgacagagagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagaggcaacagccugagcggcguggagggcgagggccugcacagacugggcuacauccugagagacgugagcaagaaggagggcggcgccauguacgccgacgacaccgccggcugggacaccagaaucacccuggaggaccugaagaacgaggagauggugaccaaccacaugaagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcaucuucaagagcauccagcaccugaccgugaccgaggagaucgccgugcagaacuggcuggccagagugggcagagagagacugagcagaauggccaucagcggcgacgacugcguggugaagccccuggacgacagauucgccagcgcccugaccgcccugaacgacaugggcaaggugagaaaggacauccagcagugggagcccagcagaggcuggaacgacuggacccaggugcccuucugcagccaccacuuccacgagcuggugaugaaggacggcagagugcugguggugcccugcagaaaccaggacgagcugaucggcagagccagaaucagccagggcgccggcuggagccugaaggagaccgccugccugggcaagagcuacgcccagauguggacccugauguacuuccacagaagagaccugagacuggccgccaacgccaucugcagcgccgugcccagccacugggugcccaccagcagaaccaccuggagcauccacgccaagcacgaguggaugaccaccgaggacaugcuggccguguggaacagaguguggauccaggagaaccccuggauggaggacaagacccccguggagagcugggaggaggugcccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 17648 - RNA, 9876 nt, Artificial Sequence
  derived and/or modified CDS sequence (opt4) from DENV-2__GQ398285__SS-prME
accgccggcgugaucaucaugcugauccccaccgccauggccuuccaccugaccaccagaaacggcgagccccacaugaucgugggcagacaggagaagggcaagagccugcuguucaagaccgaggacggcgugaacaugugcacccugauggccaucgaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgugcagagaaucgagaccuggauccugagacaccccggcuucaccaucauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaacgaggagcaggacaagagauucgugugcaagcacagcaugguggacagaggcuggggcaacggcugcggccuguucggcaagggcggcaucgugaccugcgccauguucaccugcaagaagaacauggagggcaagguggugcugcccgagaaccuggaguacaccaucgugaucaccccccacagcggcgaggagcacgccgugggcaacgacaccggcaagcacggcaaggagaucaagaucaccccccagagcagcaucaccgaggccgagcugaccggcuacggcaccgugaccauggagugcagccccagaaugggccuggacuucaacgagauggugcugcugcagauggaggacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagaucgugaaggagaucgccgagacccagcacggcaccaucgugaucagagugcaguacgagggcgacggcagccccugcaagauccccuucgagaucauggaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcaccaucuacggcgccgccuucagcggcgugagcuggaccaugaagauccugaucggcgugaucaucaccuggaucggcaugaacagcagaagcaccagccugagcgugagccuggugcuggugggcguggugacccuguaccugggcgccauggugcaggccgacagcggcugcguggugagcuggaagagcaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcggcaucaagggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucaccaccaacaucuggcugaagcugagagagaagcaggacguguucugcgacagcaagcugaugagcgccgccaucaaggacaacagagccgugcacgccgacaugggcuacuggaucgagagcgcccugaacgacaccuggaagauggagaaggccagcuucaucgaggugaagagcugccacuggcccaagagccacacccuguggagcaacggcgugcuggagagcgagaugaucauccccaagaaccuggccggccccgugagccagcacaacuacagacccggcuaccacacccagaccgccggccccuggcaccugggcaagcuggagauggacuucgacuucugcgagggcaccaccgugguggugaccgaggacugcggcaacagaggccccagccugagaaccaccaccgccagcggcaagcuggugaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugauggccaccaucggcaucgcccugcugagccagagcaccauccccgagaccauccuggagcugaccgacgcccuggcccugggcaugauggugcugaagaucgugagaaacauggagaaguaccagcuggccgugaccaucauggccaucagcugcgugcccaacgccgugauccugcagaacgccuggaaggugagcugcaccauccuggccgccgugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggcguguuccccgugagcauccccaucaccgccgccgccugguaccugugggaggugaagaagcagagagccggcgugcugugggacgugcccagccccccccccgugggcaaggccgagcuggaggacggcgccuacagaaucaagcagagaggcauccugggcuacagccagaucggcgccggcguguacaaggagggcaccuuccacaccauguggcacgugaccagaggcgccgugcugaugcacagaggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucguggacagaaagggcaagguggugggccuguacggcaacggcguggugaccagaagcggcgccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagagccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacagaguggccgccgagggcaucaacuacgccgacagaagauggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagaaacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucaccacccaggagagcgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggagcccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccaucgaggccggcagaacccugagagugcugaaccugguggagaacuggcugaacaacaacacccaguucugcaucaaggugcugaaccccuacaugcccagcgugaucgagaagauggagacccugcagagaaaguacggcggcgcccuggugagaaacccccugagcagaaacagcacccacgagauguacugggugagcaacgccaccggcaacaucgugagcagcgugaacaugaucagcagaaugcugaucaacagauucaccaugaagcacaagaaggccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacguggugcccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaaggagaagacccccagaaugugcaccagagaggaguucgccagaaaggugagaagcaacgccgcccugggcgccaucuucaccgacgagaacaaguggaagagcgccagagaggccguggaggacagcagauucugggagcugaucgacagagagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacagacugggcuacauccugagagacgugagcaagaaggagggcggcgccauguacgccgacgacaccgccggcugggacaccagaaucacccuggaggaccugaagaacgaggagauggugaccaaccacaugaagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcaucuucaagagcauccagcaccugaccgccaccgaggagaucgccgugcagaacuggcuggccagagugggcagagagagacugagcagaauggccaucagcggcgacgacugcguggugaagccccuggacgacagauucgccagcgcccugaccgcccugaacgacaugggcaaggugagaaaggacauccagcagugggagcccagcagaggcuggaacgacuggacccaggugcccuucugcagccaccacuuccacgagcuggugaugaaggacggcagagugcugguggugcccugcagaaaccaggacgagcugaucggcagagccagaaucagccagggcgccggcuggagccugaaggagaccgccugccugggcaagagcuacgcccagauguggacccugauguacuuccacagaagagaccugagacuggccgccaacgccaucugcagcgccgugcccagccacugggugcccaccagcagaaccaccuggagcauccacgccaagcacgaguggaugaccaccgaggacaugcuggccguguggaacagaguguggauccaggagaaccccuggauggaggacaagacccccguggagagcugggaggaggugcccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 17649 - RNA, 9876 nt, Artificial Sequence
  derived and/or modified CDS sequence (opt4) from DENV-2__GQ398298__SS-prME
accgccggcgugaucaucaugcugauccccaccgccauggccuuccaccugaccaccagaaacggcgagccccacaugaucgugggcagacaggagaagggcaagagccugcuguucaagaccgaggacggcgugaacaugugcacccugauggccaucgaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgugcagagaaucgagaccuggauccugagacaccccggcuucaccaucauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaacgaggagcaggacaagagauucgugugcaagcacagcaugguggacagaggcuggggcaacggcugcggccuguucggcaagggcggcaucgugaccugcgccauguucaccugcaagaagaacauggagggcaagguggugcugcccgagaaccuggaguacaccaucgugaucaccccccacagcggcgaggagcacgccgugggcaacgacaccggcaagcacggcaaggagaucaagaucaccccccagagcagcaucaccgaggccgagcugaccggcuacggcaccgugaccauggagugcagccccagaaccggccuggacuucaacgagauggugcugcugcagauggaggacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagaucgugaaggagaucgccgagacccagcacggcaccaucgugaucagagugcaguacgagggcgacggcagccccugcaagauccccuucgagaucauggaccuggagaagagacacgugcugggcagacugaucaccgugaaccccaucguggccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcguggugacccuguaccugggcgccauggugcaggccgacagcggcugcguggugagcuggaagagcaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucaccaccaacaucuggcugaagcugagagagaagcaggacguguucugcgacagcaagcugaugagcgccgccaucaaggacaacagagccgugcacgccgacaugggcuacuggaucgagagcgcccugaacgacaccuggaagauggagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcaagcuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggccugcugggcauggcccuguuccuggaggagaugcugagaaccagagugggcaccaagcacgccaugcugcuggugguggugagcuucgugacccugaucaccggcaacaugagcuucagagaccugggcagagugauggugauggugggcgccaccaugaccgacgacaucggcaugggcaucaccuaccuggcccugcuggccgccuucaaggugagacccaccuucgccgccggccugcugcugagaaagcugaccagcaaggagcugaugauggccaccaucggcaucgcccugcugagccagagcaccauccccgagaccauccuggagcugaccgacgcccuggcccugggcaugauggugcugaagaucgugagaaacauggagaaguaccagcuggccgugaccaucauggccaucagcugcgugcccaacgccgugauccugcagaacgccuggaaggugagcugcaccauccuggccgccgugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggcguguuccccgugagcauccccaucaccgccgccgccugguaccugugggaggugaagaagcagagagccggcgugcugugggacgugcccagccccccccccgugggcaaggccgagcuggaggacggcgccuacagaaucaagcagagaggcauccugggcuacagccagaucggcgccggcguguacaaggagggcaccuuccacaccauguggcacgugaccagaggcgccgugcugaugcacagaggcaagagaaucgagcccagcugggccgacaucaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucguggacagaaagggcaagguggugggccuguacggcaacggcguggugaccagaagcggcgccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagagccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacagaguggccgccgagggcaucaacuacgccgacagaagauggugcuucgacggcaucagaaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagagacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucgccacccaggagagcgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggagcccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccaucgaggccggcagaacccugagagugcugaaccugguggagaacuggcugaacaacaacacccaguucugcaucaaggugcugaaccccuacaugcccagcgugaucgagaagauggagacccugcagagaaaguacggcggcgcccuggugagaaacccccugagcagaaacagcacccacgagauguacugggugagcaacgccaccggcaacaucgugagcagcgugaacaugaucagcagaaugcugaucaacagauucaccaugaagcacaagaaggccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacguggugcccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcagauucugggagcugaucgacagagagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagaggcaacagccugagcggcguggagggcgagggccugcacagacugggcuacauccugagagacgugagcaagaaggagggcggcgccauguacgccgacgacaccgccggcugggacaccagaaucacccuggaggaccugaagaacgaggagauggugaccaaccacaugaagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcaucuucaagagcauccagcaccugaccgugaccgaggagaucgccgugcagaacuggcuggccagagugggcagagagagacugagcagaauggccaucagcggcgacgacugcguggugaagccccuggacgacagauucgccagcgcccugaccgcccugaacgacaugggcaaggugagaaaggacauccagcagugggagcccagcagaggcuggaacgacuggacccaggugcccuucugcagccaccacuuccacgagcuggugaugaaggacggcagagugcugguggugcccugcagaaaccaggacgagcugaucggcagagccagaaucagccagggcgccggcuggagccugaaggagaccgccugccugggcaagagcuacgcccagauguggacccugauguacuuccacagaagagaccugagacuggccgccaacgccaucugcagcgccgugcccagccacugggugcccaccagcagaaccaccuggagcauccacgccaagcacgaguggaugaccaccgaggacaugcuggccguguggaacagaguguggauccaggagaaccccuggauggaggacaagacccccguggagagcugggaggaggugcccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 17650 - RNA, 9876 nt, Artificial Sequence
  derived and/or modified CDS sequence (opt4) from DENV-2__GQ398301__SS-prME
accgccggcgugaucaucaugcugauccccaccgccauggccuuccaccugaccaccagaaacggcgagccccacaugaucgugggcagacaggagaagggcaagagccugcuguucaagaccgaggacggcgugaacaugugcacccugauggccaucgaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgugcagagaaucgagaccuggauccugagacaccccggcuucaccaucauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaacgaggagcaggacaagagauucgugugcaagcacagcaugguggacagaggcuggggcaacggcugcggccuguucggcaagggcggcaucgugaccugcgccauguucaccugcaagaagaacauggagggcaagguggugcugcccgagaaccuggaguacaccaucgugaucaccccccacagcggcgaggagcacgccgugggcaacgacaccggcaagcacggcaaggagaucaagaucaccccccagagcagcaucaccgaggccgagcugaccggcuacggcaccgugaccauggagugcagccccagaaccggccuggacuucaacgagauggugcugcugcagauggaggacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagaucgugaaggagaucgccgagacccagcacggcaccaucgugaucagagugcaguacgagggcgacggcagccccugcaagauccccuucgagaucauggaccuggagaagagacacgugcugggcagacugaucaccgugaaccccaucguggccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcguggugacccuguaccugggcgccauggugcaggccgacagcggcugcguggugagcuggaagagcaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucaccaccaacaucuggcugaagcugagagagaagcaggacguguucugcgacagcaagcugaugagcgccgccaucaaggacaacagagccgugcacgccgacaugggcuacuggaucgagagcgcccugaacgacaccuggaagauggagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcaagcuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccaugcugcugguggccgccagcuucgugacccugaucaccggcaacaugagcuucagagaccugggcagagugauggugauggugggcgccaccaugaccgacgacaucggcaugggcaucaccuaccuggcccugcuggccgccuucaaggugagacccaccuucgccgccggccugcugcugagaaagcugaccagcaaggagcugaugauggccaccaucggcaucgcccugcugagccagagcaccauccccgagaccauccuggagcugaccgacgcccuggcccugggcaugauggugcugaagaucgugagaaacauggagaaguaccagcuggccgugaccaucauggccaucagcugcgugcccaacgccgugauccugcagaacgccuggaaggugagcugcaccauccuggccgccgugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggcguguuccccgugagcauccccaucaccgccgccgccugguaccugugggaggugaagaagcagagagccggcgugcugugggacgugcccagccccccccccgugggcaaggccgagcuggaggacggcgccuacagaaucaagcagagaggcauccugggcuacagccagaucggcgccggcguguacaaggagggcaccuuccacaccauguggcacgugaccagaggcgccgugcugaugcacagaggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucguggacagaaagggcaagguggugggccuguacggcaacggcguggugaccagaagcggcgccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagagccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacagaguggccgccgagggcaucaacuacgccgacagaagauggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagagacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucgccacccaggagagcgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggagcccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccaucgaggccggcagaacccugagagugcugaaccugguggagaacuggcugaacaacaacacccaguucugcaucaaggugcugaaccccuacaugcccagcgugaucgagaagauggagacccugcagagaaaguacggcggcgcccuggugagaaacccccugagcagaaacagcacccacgagauguacugggugagcaacgccaccggcaacaucgugagcagcgugaacaugaucagcagaaugcugaucaacagauucaccaugaagcacaagaaggccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacguggugcccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaaggagaagacccccagaaugugcaccagagaggaguucaccagaaaggugagaagcaacgccgcccugggcgccaucuucaccgacgagaacaaguggaagagcgccagagaggccguggaggacagcagauucugggagcugaucgacagagagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagaggcaacagccugagcggcguggagggcgagggccugcacagacugggcuacauccugagagacgugagcaagaaggagggcggcgccauguacgccgacgacaccgccggcugggacaccagaaucacccuggaggaccugaagaacgaggagauggugaccaaccacaugaagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcaucuucaagagcauccagcaccugaccgugaccgaggagaucgccgugcagaacuggcuggccagagugggcagagagagacugagcagaauggccaucagcggcgacgacugcguggugaagccccuggacgacagauucgccagcgcccugaccgcccugaacgacaugggcaaggugagaaaggacauccagcagugggagcccagcagaggcuggaacgacuggacccaggugcccuucugcagccaccacuuccacgagcuggugaugaaggacggcagagugcugguggugcccugcagaaaccaggacgagcugaucggcagagccagaaucagccagggcgccggcuggagccugaaggagaccgccugccugggcaagagcuacgcccagauguggacccugauguacuuccacagaagagaccugagacuggccgccaacgccaucugcagcgccgugcccagccacugggugcccaccagcagaaccaccuggagcauccacgccaagcacgaguggaugaccaccgaggacaugcuggccguguggaacagaguguggauccaggagaaccccuggauggaggacaagacccccguggagagcugggaggaggugcccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 17651 - RNA, 9876 nt, Artificial Sequence
  derived and/or modified CDS sequence (opt4) from DENV-2__GQ398312__SS-prME
accgccggcgugaucaucaugcugauccccaccgccauggccuuccaccugaccaccagaaacggcgagccccacaugaucgugggcagacaggagaagggcaagagccugcuguucaagaccgaggacggcgugaacaugugcacccugauggccaucgaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgugcagagaaucgagaccuggauccugagacaccccggcuucaccaucauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaacgaggagcaggacaagagauucgugugcaagcacagcaugguggacagaggcuggggcaacggcugcggccuguucggcaagggcggcaucgugaccugcgccauguucaccugcaagaagaacauggagggcaagguggugcugcccgagaaccuggaguacaccaucgugaucaccccccacagcggcgaggagcacgccgugggcaacgacaccggcaagcacggcaaggagaucaagaucaccccccagagcagcaucaccgaggccgagcugaccggcuacggcaccgugaccauggagugcagccccagaaccggccuggacuucaacgagauggugcugcugcagauggaggacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagaucgugaaggagaucgccgagacccagcacggcaccaucgugaucagagugcaguacgagggcgacggcagccccugcaagauccccuucgagaucauggaccuggagaagagacacgugcugggcagacugaucaccgugaaccccaucguggccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcguggugacccuguaccugggcgccauggugcaggccgacagcggcugcguggugagcuggaagagcaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucagcaccaacaucuggcugaagcugagagagaagcaggacguguucugcgacagcaagcugaugagcgccgccaucaaggacaacagagccgugcacgccgacaugggcuacuggaucgagagcgcccugaacgacaccuggaagauggagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcaagcuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccaugcugcugguggccgugagcuucgugacccugaucaccggcaacaugagcuucagagaccugggcagagugauggugauggugggcgccaccaugaccgacgacaucggcaugggcaucaccuaccuggcccugcuggccgccuucaaggugagacccaccuucgccgccggccugcugcugagaaagcugaccagcaaggagcugaugauggccaccaucggcaucgcccugcugagccagagcaccauccccgagaccauccuggagcugaccgacgcccuggcccugggcaugauggugcugaagaucgugagaaacauggagaaguaccagcuggccgugaccaucauggccaucagcugcgugcccaacgccgugauccugcagaacgccuggaaggugagcugcaccauccuggccgccgugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggcguguuccccgugagcauccccaucaccgccgccgccugguaccugugggaggugaagaagcagagagccggcgugcugugggacgugcccagccccccccccgugggcaaggccgagcuggaggacggcgccuacagaaucaagcagagaggcauccugggcuacagccagaucggcgccggcguguacaaggagggcaccuuccacaccauguggcacgugaccagaggcgccgugcugaugcacagaggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucguggacagaaagggcaagguggugggccuguacggcaacggcguggugaccagaagcggcgccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagagccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacagaguggccgccgagggcaucaacuacgccgacagaagauggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagagacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucgccacccaggagagcgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaucgccgcccugcugcugcugguggcccacuacgccaucaucggccccggccugcaggccaaggccaccagagaggcccagaagagagccgccgccggcaucaugaagaaccccaccguggacggcaucaccgugaucgaccuggagcccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccaucgaggccggcagaacccugagagugcugaaccugguggagaacuggcugaacaacaacacccaguucugcaucaaggugcugaaccccuacaugcccagcgugaucgagaagauggagacccugcagagaaaguacggcggcgcccuggugagaaacccccugagcagaaacagcacccacgagauguacugggugagcaacgccaccggcaacaucgugagcagcgugaacaugaucagcagaaugcugaucaacagauucaccaugaagcacaagaaggccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacguggugcccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcagauucugggagcugaucgacagagagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagaggcaacagccugagcggcguggagggcgagggccugcacagacugggcuacauccugagagacgugagcaagaaggagggcggcgccauguacgccgacgacaccgccggcugggacaccagaaucacccuggaggaccugaagaacgaggagauggugaccaaccacaugaagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcaucuucaagagcauccagcaccugaccgugaccgaggagaucgccgugcagaacuggcuggccagagugggcagagagagacugagcagaauggccaucagcggcgacgacugcguggugaagccccuggacgacagauucgccagcgcccugaccgcccugaacgacaugggcaaggugagaaaggacauccagcagugggagcccagcagaggcuggaacgacuggacccaggugcccuucugcagccaccacuuccacgagcuggugaugaaggacggcagagugcugguggugcccugcagaaaccaggacgagcugaucggcagagccagaaucagccagggcgccggcuggagccugaaggagaccgccugccugggcaagagcuacgcccagauguggacccugauguacuuccacagaagagaccugagacuggccgccaacgccaucugcagcgccgugcccagccacugggugcccaccagcagaaccaccuggagcauccacgccaagcacgaguggaugaccaccgaggacaugcuggccguguggaacagaguguggauccaggagaaccccuggauggaggacaagacccccguggagagcugggaggaggugcccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 17652 - RNA, 9876 nt, Artificial Sequence
  derived and/or modified CDS sequence (opt4) from DENV-2__GQ398289__SS-prME
accgccggcgugaucaucaugcugauccccaccgccauggccuuccaccugaccaccagaaacggcgagccccacaugaucgugggcagacaggagaagggcaagagccugcuguucaagaccgaggacggcgugaacaugugcacccugauggccaucgaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgugcagagaaucgagaccuggauccugagacaccccggcuucgccaucauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaacgaggagcaggacaagagauucgugugcaagcacagcaugguggacagaggcuggggcaacggcugcggccuguucggcaagggcggcaucgugaccugcgccauguucaccugcaagaagaacauggagggcaagguggugcugcccgagaaccuggaguacaccaucgugaucaccccccacagcggcgaggagcacgccgugggcaacgacaccggcaagcacggcaaggagaucaagaucaccccccagagcagcaucaccgaggccgagcugaccggcuacggcaccgugaccauggagugcagccccagaaccggccuggacuucaacgagauggugcugcugcagauggaggacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagaucgugaaggagaucgccgagacccagcacggcaccaucgugaucagagugcaguacgagggcgacggcagccccugcaagauccccuucgagaucauggaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcguggugacccuguaccugggcgccauggugcaggccgacagcggcugcguggugagcuggaagagcaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaccaagggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucaccaccaacaucuggcugaagcugagagagaagcaggacguguucugcgacagcaagcugaugagcgccgccaucaaggacaacagagccgugcacgccgacaugggcuacuggaucgagagcgcccugaacgacaccuggaagauggagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcaagcuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugaucgccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugauggccaccaucggcaucgcccugcugagccagagcaccauccccgagaccauccuggagcugaccgacgcccuggcccugggcaugauggugcugaagaucgugagaaacauggagaaguaccagcuggccgugaccaucauggccaucagcugcgugcccaacgccgugauccugcagaacgccuggaaggugagcugcaccauccuggccgccgugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggcguguuccccgugagcauccccaucaccgccgccgccugguaccugugggaggugaagaagcagagagccggcgugcugugggacgugcccagccccccccccgugggcaaggccgagcuggaggacggcgccuacagaaucaagcagagaggcauccugggcuacagccagaucggcgccggcguguacaaggagggcaccuuccacaccauguggcacgugaccagaggcgccgugcugaugcacagaggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucguggacagaaagggcaagguggugggccuguacggcaacggcguggugaccagaagcggcgccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagagccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagccuguucgagcccgagagagagaagguggacgccaucgacggcgaguacagacugagaggcgaggccagaaagaccuucguggaccugaugagaagaggcgaccugcccguguggcuggccuacagaguggccgccgagggcaucaacuacgccgacagaagauggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagagacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcagaggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucaccacccaggagagcgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggagcccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccaucgaggccggcagaacccugagagugcugaaccugguggagaacuggcugaacaacaacacccaguucugcaucaaggugcugaaccccuacaugcccagcgugaucgagaagauggagacccugcagagaaaguacggcggcgcccuggugagaaacccccugagcagaaacagcacccacgagauguacugggugagcaacgccaccggcaacaucgugagcagcgugaacaugaucagcagaaugcugaucaacagauucaccaugaagcacaagaaggccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacguggugcccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcagauucugggagcugaucgacagagagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagaagaaacagccugagcggcguggagggcgagggccugcacagacugggcuacauccugagagacgugagcaagaaggagggcggcgccauguacgccgacgacaccgccggcugggacaccagaaucacccuggaggaccugaagaacgaggagauggugaccaaccacaugaagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcaucuucaagagcauccagcaccugaccgugaccgaggagaucgccgugcagaacuggcuggccagagugggcagagagagacugagcagaauggccaucagcggcgacgacugcguggugaagccccuggacgacagauucgccagcgcccugaccgcccugaacgacaugggcaaggugagaaaggacauccagcagugggagcccagcagaggcuggaacgacuggacccaggugcccuucugcagccaccacuuccacgagcuggugaugaaggacggcagagugcugguggugcccugcagaaaccaggacgagcugaucggcagagccagaaucagccagggcgccggcuggagccugaaggagaccgccugccugggcaagagcuacgcccagauguggacccugauguacuuccacagaagagaccugagacuggccgccaacgccaucugcagcgccgugcccagccacugggugcccaccagcagaaccaccuggagcauccacgccaagcacgaguggaugaccaccgaggacaugcuggccguguggaacagaguguggauccaggagaaccccuggauggaggacaagacccccguggagagcugggaggaggugcccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 17653 - RNA, 9876 nt, Artificial Sequence
  derived and/or modified CDS sequence (opt4) from DENV-2__GQ398290__SS-prME
accgccggcgugaucaucaugcugauccccaccgccauggccuuccaccugaccaccagaaacggcgagccccacaugaucgugggcagacaggagaagggcaagagccugcuguucaagaccgaggacggcgugaacaugugcacccugauggccaucgaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgugcagagaaucgagaccuggauccugagacaccccggcuucaccaucauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaacgaggagcaggacaagagauucgugugcaagcacagcaugguggacagaggcuggggcaacggcugcggccuguucggcaagggcggcaucgugaccugcgccauguucaccugcaagaagaacauggagggcaagguggugcugcccgagaacuucgaguacaccaucgugaucaccccccacagcggcgaggagcacgccgugggcaacgacaccggcaagcacggcaaggagaucaagaucaccccccagagcagcaucaccgaggccgagcugaccggcuacggcaccgugaccauggagugcagccccagaaccggccuggacuucaacgagauggugcugcugcagauggaggacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagaucgugaaggagaucgccgagacccagcacggcaccaucgugaucagagugcaguacgagggcgacggcagccccugcaagauccccuucgagaucauggaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcguggugacccuguaccugggcgccauggugcaggccgacagcggcugcguggugagcuggaagagcaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucaccaccaacaucuggcugaagcugagagagaagcaggacguguucugcgacagcaagcugaugagcgccgccaucaaggacaacagagccgugcacgccgacaugggcuacuggaucgagagcgcccugaacgacaccuggaagauggagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcaagcuggagauggacuucgaccugugcgagggcaccaccgugguggugaccgagaacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugauggccaccaucggcaucgcccugcugagccagagcaccauccccgagaccauccuggagcugaccgacgcccuggcccugggcaugauggugcugaagaucgugagaaacauggagaaguaccagcuggccgugaccaucauggccaucagcugcgugcccaacgccgugauccugcagaacgccuggaaggugagcugcaccauccuggccgccgugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggcguguuccccgugagcauccccaucaccgccgccgccugguaccugugggaggugaagaagcagagagccggcgugcugugggacgugcccagccccccccccgugggcaaggccgagcuggaggacggcgccuacagaaucaagcagagaggcauccugggcuacagccagaucggcgccggcguguacaaggagggcaccuuccacaccauguggcacgugaccagaggcgccgugcugaugcacagaggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucguggacagaaagggcaagguggugggccuguacggcaacggcguggugaccagaagcggcgccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagagccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacagaguggccgccgagggcaucaacuacgccgacagaagauggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagagacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcagaggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucaccacccaggagagcgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggagcccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacacccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccaucgaggccggcagaacccugagagugcugaaccugguggagaacuggcugaacaacaacacccaguucugcaucaaggugcugaaccccuacaugcccagcgugaucgagaagauggagacccugcagagaaaguacggcggcgcccuggugagaaacccccugagcagaaacagcacccacgagauguacugggugagcaacgccaccggcaacaucgugagcagcgugaacaugaucagcagaaugcugaucaacagauucaccaugaagcacaagaaggccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacguggugcccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcagauucugggagcugaucgacagagagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagaggcaacagccugagcggcguggagggcgagggccugcacagacugggcuacauccugagagacgugagcaagaaggagggcggcgccauguacgccgacgacaccgccggcugggacaccagaaucacccuggaggaccugaagaacgaggagauggugaccaaccacaugaagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcaucuucaagagcauccagcaccugaccgccaccgaggagaucgccgugcagaacuggcuggccagagugggcagagagagacugagcagaauggccaucagcggcgacgacugcguggugaagccccuggacgacagauucgccagcgcccugaccgcccugaacgacaugggcaaggugagaaaggacauccagcagugggagcccagcagaggcuggaacgacuggacccaggugcccuucugcagccaccacuuccacgagcuggugaugaaggacggcagagugcugguggugcccugcagaaaccaggacgagcugaucggcagagccagaaucagccagggcgccggcuggagccugaaggagaccgccugccugggcaagagcuacgcccagauguggacccugauguacuuccacagaagagaccugagacuggccgccaacgccaucugcagcgccgugcccagccacugggugcccaccagcagaaccaccuggagcauccacgccaagcacgaguggaugaccaccgaggacaugcuggccguguggaacagaguguggauccaggagaaccccuggauggaggacaagacccccguggagagcugggaggaggugcccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 17654 - RNA, 9876 nt, Artificial Sequence
  derived and/or modified CDS sequence (opt4) from DENV-2__GQ398284__SS-prME
accgccggcgugaucaucaugcugauccccaccgccauggccuuccaccugaccaccagaaacggcgagccccacaugaucgugggcaagcaggagaagggcaagagccugcuguucaagaccgaggacggcgugaacaugugcacccugauggccaucgaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgugcagagaaucgagaccuggauccugagacaccccggcuucaccaucauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaacgaggagcaggacaagagauuccugugcaagcacagcaugguggacagaggcuggggcaacggcugcggccuguucggcaagggcggcaucgugaccugcgccauguucaccugcaagaagaacauggagggcaagguggugcagcccgagaaccuggaguacaccaucgugaucaccccccacagcggcgaggagcacgccgugggcaacgacaccggcaagcacggcaaggagaucaagaucaccccccagagcagcaucaccgaggccgagcugaccggcuacggcaccgugaccauggagugcagccccagaaccggccuggacuucaacgagauggugcugcugcagauggaggacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggcccugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagaucgugaaggagaucgccgagacccagcacggcaccaucgugaucagagugcaguacgagggcgacggcagccccugcaagauccccuucgagaucauggaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacagagccgccuucagcggcgugagcuggaccaugaagauccugaucggcgugaucaucaccuggaucggcaugaacagcagaagcaccagccugagcgugagccuggugcuggugggcguggugacccuguaccugggcgccauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucaccaccaacaucuggcugaagcugagagagaagcaggacguguucugcgacagcaagcugaugagcgccgccaucaaggacaacagagccgugcacgccgacaugggcuacuggaucgagagcgcccugaacgacaccuggaagauggagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcaagcuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugauggccaccaucggcaucgcccugcugagccagagcaccauccccgagaccauccuggagcugaccgacgcccuggcccugggcaugauggugcugaagaucgugagaaacauggagaaguaccagcuggccgugaccaucauggccaucagcugcgugcccaacgccgugauccugcagaacgccuggaaggugagcugcaccauccuggccgccgugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggcguguuccccgugagcauccccaucaccgccgccgccugguaccugugggaggugaagaagcagagagccggcgugcugugggacgugcccagccccccccccgugggcaaggccgagcuggaggacggcgccuacagaaucaagcagagaggcauccugggcuacagccagaucggcgccggcguguacaaggagggcaccuuccacaccauguggcacgugaccagaggcgccgugcugaugcacagaggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucguggacagaaagggcaagguggugggccuguacggcaacggcguggugaccagaagcggcgccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagagccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacagaguggccgccgagggcaucaacuacgccgacagaagauggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagagacgcccuggacaaccuggccgugcugcacaccgccgaggccggcggcaaggccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucaucacccaggagagcgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggagcccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccaucgaggccggcagaacccugagagugcugaaccugguggagaacuggcugaacaacaacacccaguucugcaucaaggugcugaaccccuacaugcccagcgugaucgagaagauggagacccugcagagaaaguacggcggcgcccuggugagaaacccccugagcagaaacagcacccacgagauguacugggugagcaacgccaccggcaacaucgugagcagcgugaacaugaucagcagaaugcugaucaacagauucaccaugaagcacaagaaggccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacguggugcccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcagauucugggagcugguggacagagagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagaggcaacagccugagcggcguggagggcgagggccugcacagacugggcuacauccugagagacgugagcaagaaggagggcggcgccauguacgccgacgacaccgccggcugggacaccagaaucacccuggaggaccugaagaacgaggagauggugaccaaccacaugaagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcaucuucaagagcauccagcaccugaccgugaccgaggagaucgccgugcagaacuggcuggccagagugggcagagagagacugagcagaauggccaucagcggcgacgacugcguggugaagccccuggacgacagauucgccagcgcccugaccgcccugaacgacaugggcaaggugagaaaggacauccagcagugggagcccagcagaggcuggaacgacuggacccaggugcccuucugcagccaccacuuccacgagcuggugaugaaggacggcagagugcugguggugcccugcagaaaccaggacgagcugaucggcagagccagaaucagccagggcgccggcuggagccugaaggagaccgccugccugggcaagagcuacgcccagauguggacccugauguacuuccacagaagagaccugagacuggccgccaacgccaucugcagcgccgugcccagccacugggugcccaccagcagaaccaccuggagcauccacgccaaccacgaguggaugaccaccgaggacaugcuggccguguggaacagaguguggauccaggagaaccccuggauggaggacaagacccccguggagagcugggaggaggugcccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 17655 - RNA, 9876 nt, Artificial Sequence
  derived and/or modified CDS sequence (opt4) from DENV-2__GQ398308__SS-prME
accgccggcgugaucaucaugcugauccccaccgccauggccuuccaccugaccaccagaaacggcgagccccacaugaucgugggcagacaggagaagggcaagagccugcuguucaagaccgaggacggcgugaacaugugcacccugauggccaucgaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgugcagagaaucgagaccuggauccugagacaccccggcuucaccaucauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaacgaggagcaggacaagagauucgugugcaagcacagcaugguggacagaggcuggggcaacggcugcggccuguucggcaagggcggcaucgugaccugcgccauguucaccugcaagaagaacauggagggcaagguggugcugcccgagaaccuggaguacaccaucgugaucaccccccacagcggcgaggagcacgccgugggcaacgacaccggcaagcacggcaaggagaucaagaucaccccccagagcagcaucaccgaggccgagcugaccggcuacggcaccgugaccauggagugcagccccagaaccggccuggacuucaacgagauggugcugcugcagauggaggacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagaucgugaaggagaucgccgagacccagcacggcaccaucgugaucagagugcaguacgagggcgacggcagccccugcaagauccccuucgagaucauggaccuggagaagagacacgugcugggcagacugaucaccgugaaccccaucguggccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcguggugacccuguaccugggcgccauggugcaggccgacagcggcugcguggugagcuggaagagcaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucagcaccaacaucuggcugaagcugagagagaagcaggacguguucugcgacagcaagcugaugagcgccgccaucaaggacaacagagccgugcacgccgacaugggcuacuggaucgagagcgcccugaacgacaccuggaagauggagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcaagcuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccaugcugcugguggccgugagcuucgugacccugaucaccggcaacaugagcuucagagaccugggcagagugauggugauggugggcgccaccaugaccgacgacaucggcaugggcaucaccuaccuggcccugcuggccgccuucaaggugagacccaccuucgccgccggccugcugcugagaaagcugaccagcaaggagcugaugauggccaccaucggcaucgcccugcugagccagagcaccauccccgagaccauccuggagcugaccgacgcccuggcccugggcaugauggugcugaagaucgugagaaacauggagaaguaccagcuggccgugaccaucauggccaucagcugcgugcccaacgccgugauccugcagaacgccuggaaggugagcugcaccauccuggccgccgugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggcguguuccccgugagcauccccaucaccgccgccgccugguaccugugggaggugaagaagcagagagccggcgugcugugggacgugcccagccccccccccgugggcaaggccgagcuggaggacggcgccuacagaaucaagcagagaggcauccugggcuacagccagaucggcgccggcguguacaaggagggcaccuuccacaccauguggcacgugaccagaggcgccgugcugaugcacagaggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucguggacagaaagggcaagguggugggccuguacggcaacggcguggugaccagaagcggcgccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagagccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacagaguggccgccgagggcaucaacuacgccgacagaagauggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagagacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucgccacccaggagagcgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggagcccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccaucgaggccggcagaacccugagagugcugaaccugguggagaacuggcugaacaacgacacccaguucugcaucaaggugcugaaccccuacaugcccagcgugaucgagaagauggagacccugcagagaaaguacggcggcgccaucgugagaaacccccugagcagaaacagcacccacgagauguacugggugagcaacgccaccggcaacaucgugagcagcgugaacaugaucagcagaaugcugaucaacagauucaccaugaagcacaagaaggccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacguggugcccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcagauucugggagcugaucgacagagagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagaggcaacagccugagcggcguggagggcgagggccugcacagacugggcuacauccugagagacgugagcaagaaggagggcggcgccauguacgccgacgacaccgccggcugggacaccagaaucacccuggaggaccugaagaacgaggagauggugaccaaccacaugaagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcaucuucaagagcauccagcaccugaccgugaccgaggagaucgccgugcagaacuggcuggccagagugggcagagagagacugagcagaauggccaucagcggcgacgacugcguggugaagccccuggacgacagauucgccagcgcccugaccgcccugaacgacaugggcaaggugagaaaggacauccagcagugggagcccagcagaggcuggaacgacuggacccaggugcccuucugcagccaccacuuccacgagcuggugaugaaggacggcagagugcugguggugcccugcagaaaccaggacgagcugaucggcagagccagaaucagccagggcgccggcuggagccugaaggagaccgccugccugggcaagagcuacgcccagauguggacccugauguacuuccacagaagagaccugagacuggccgccaacgccaucugcagcgccgugcccagccacugggugcccaccagcagaaccaccuggagcauccacgccaagcacgaguggaugaccaccgaggacaugcugaccguguggaacagaguguggauccaggagaaccccuggauggaggacaagacccccguggagagcugggaggaggugcccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 17656 - RNA, 9876 nt, Artificial Sequence
  derived and/or modified CDS sequence (opt4) from DENV-2__GQ398287__SS-prME
accgccggcgugaucaucaugcugauccccaccgccauggccuuccaccugaccaccagaaacggcgagccccacaugaucgugggcagacaggagaagggcaagagccugcuguucaagaccgaggacggcgugaacaugugcacccugauggccaucgaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgugcagagaaucgagaccuggauccugagacaccccggcuucgccaucauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaacgaggagcaggacaagagauucgugugcaagcacagcaugguggacagaggcuggggcaacggcugcggccuguucggcaagggcggcaucgugaccugcgccauguucaccugcaagaagaacauggagggcaagguggugcugcccgagaaccuggaguacaccaucgugaucaccccccacagcggcgaggagcacgccgugggcaacgacaccggcaagcacggcaaggagaucaagaucaccccccagagcagcaucaccgaggccgagcugaccggcuacggcaccgugaccauggagugcagccccagaaccggccuggacuucaacgagauggugcugcugcagauggaggacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagaucgugaaggagaucgccgagacccagcacggcaccaucgugaucagagugcaguacgagggcgacggcagccccugcaagauccccuucgagaucauggaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcguggugacccuguaccugggcgccauggugcaggccgacagcggcugcguggugagcuggaagagcaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucaccaccaacaucuggcugaagcugagagagaagcaggacguguucugcgacagcaagcugaugagcgccgccaucaaggacaacagagccgugcacgccgacaugggcuacuggaucgagagcgcccugaacgacaccuggaagauggagaaggccagcuucaucgaggugaagagcugccacuggcccaagagccacacccuguggagcaacggcgugcuggagagcgagaugaucauccccaagaaccuggccggccccgugagccagcacaacuacagacccggcuaccacacccagaccgccggccccuggcaccugggcaagcuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugaucgccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugauggccaccaucggcaucgcccugcugagccagagcaccauccccgagaccauccuggagcugaccgacgcccuggcccugggcaugauggugcugaagaucgugagaaacauggagaaguaccagcuggccgugaccaucauggccaucagcugcgugcccaacgccgugauccugcagaacgccuggaaggugagcugcaccauccuggccgccgugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggcguguuccccgugagcauccccaucaccgccgccgccugguaccugugggaggugaagaagcagagagccggcgugcugugggacgugcccagccccccccccguggagaaggccgagcuggaggacggcgccuacagaaucaagcagagaggcauccugggcuacagccagaucggcgccggcguguacaaggagggcaccuuccacaccauguggcacgugaccagaggcgccgugcugaugcacagaggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucguggacagaaagggcaagguggugggccuguacggcaacggcguggugaccagaagcggcgccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagagccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagccuguucgagcccgagagagagaagguggacgccaucgacggcgaguacagacugagaggcgaggccagaaagaccuucguggaccugaugagaagaggcgaccugcccguguggcuggccuacagaguggccgccgagggcaucaacuacgccgacagaagauggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagagacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcagaggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucaccacccaggagagcgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggagcccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacaccgugcugugcgacaucggcgagagcagccccaaccccaccaucgaggccggcagaacccugagagugcugaaccugguggagaacuggcugaacaacaacacccaguucugcaucaaggugcugaaccccuacaugcccagcgugaucgagaagauggagacccugcagagaaaguacggcggcgcccuggugagaaacccccugagcagaaacagcacccacgagauguacugggugagcaacgccaccggcaacaucgugagcagcgugaacaugaucagcagaaugcugaucaacagauucaccaugaagcacaagaaggccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacguggugcccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcagauucugggagcugaucgacagagagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagaagaaacagccugagcggcguggagggcgagggccugcacagacugggcuacauccugagagacgugagcaagaaggagggcggcgccauguacgccgacgacaccgccggcugggacaccagaaucacccuggaggaccugaagaacgaggagauggugaccaaccacaugaagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcaucuucaagagcauccagcaccugaccgugaccgaggagaucgccgugcagaacuggcuggccagagugggcagagagagacugagcagaauggccaucagcggcgacgacugcguggugaagccccuggacgacagauucgccagcgcccugaccgcccugaacgacaugggcaaggugagaaaggacauccagcagugggagcccagcagaggcuggaacgacuggacccaggugcccuucugcagccaccacuuccacgagcuggugaugaaggacggcagagugcugguggugcccugcagaaaccaggacgagcugaucggcagagccagaaucagccagggcgccggcuggagccugaaggagaccgccugccugggcaagagcuacgcccagauguggacccugauguacuuccacagaagagaccugagacuggccgccaacgccaucugcagcgccgugcccagccacugggugcccaccagcagaaccaccuggagcauccacgccaagcacgaguggaugaccaccgaggacaugcuggccguguggaacagaguguggauccaggagaaccccuggauggaggacaagacccccguggagagcugggaggaggugcccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 17657 - RNA, 9876 nt, Artificial Sequence
  derived and/or modified CDS sequence (opt4) from DENV-2__GQ398302__SS-prME
accgccggcgugaucaucaugcugauccccaccgccauggccuuccaccugaccaccagaaacggcgagccccacaugaucgugagcagacaggagaagggcaagagccugcuguucaagaccgaggacggcgugaacaugugcacccugauggccaucgaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgugcagagaaucgagaccuggauccugagacaccccggcuucaccaucauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaacgaggagcaggacaagagauucgugugcaagcacagcaugguggacagaggcuggggcaacggcugcggccuguucggcaagggcggcaucgugaccugcgccauguucaccugcaagaagaacauggagggcaagguggugcugcccgagaaccuggaguacaccaucgugaucaccccccacagcggcgaggagcacgccgugggcaacgacaccggcaagcacggcaaggagaucaagaucaccccccagagcagcaucaccgaggccgagcugaccggcuacggcaccgugaccauggagugcagccccagaaccggccuggacuucaacgagauggugcugcugcagauggaggacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagaucgugaaggagaucgccgagacccagcacggcaccaucgugaucagagugcaguacgagggcgacggcagccccugcaagauccccuucgagaucauggaccuggagaagagacacgugcugggcagacugaucaccgugaaccccaucguggccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcguggugacccuguaccugggcgccauggugcaggccgacagcggcugcguggugagcuggaagagcaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucaccaccaacaucuggcugaagcugagagagaagcaggacguguucugcgacagcaagcugaugagcgccgccaucaaggacaacagagccgugcacgccgacaugggcuacuggaucgagagcgcccugaacgacaccuggaagauggagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcaagcuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccaugcugcugguggccgugagcuucgugacccugaucaccggcaacaugagcuucagagaccugggcagagugauggugauggugggcgccaccaugaccgacgacaucggcaugggcaucaccuaccuggcccugcuggccgccuucaaggugagacccaccuucgccgccggccugcugcugagaaagcugaccagcaaggagcugaugauggccaccaucggcaucgcccugcugagccagagcaccauccccgagaccauccuggagcugaccgacgcccuggcccugggcaugauggugcugaagaucgugagaaacauggagaaguaccagcuggccgugaccaucauggccaucagcugcgugcccaacgccgugauccugcagaacgccuggaaggugagcugcaccauccuggccgccgugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggcguguuccccgugagcauccccaucaccgccgccgccugguaccugugggaggugaagaagcagagagccggcgugcugugggacgugcccagccccccccccgugggcaaggccgagcuggaggacggcgccuacagaaucaagcagagaggcauccugggcuacagccagaucggcgccggcguguacaaggagggcaccuuccacaccauguggcacgugaccagaggcgccgugcugaugcacagaggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucguggacagaaagggcaagguggugggccuguacggcaacggcguggugaccagaagcggcgccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagagccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacagaguggccgccgagggcaucaacuacgccgacagaagauggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagagacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucgccacccaggagagcgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggagcccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccaucgaggccggcagaacccugagagugcugaaccugguggagaacuggcugaacaacaacacccaguucugcaucaaggugcugaaccccuacaugcccagcgugaucgagaagauggagacccugcagagaaaguacggcggcgcccuggugagaaacccccugagcagaaacagcacccacgagauguacugggugagcaacgccaccggcaacaucgugagcagcgugaacaugaucagcagaaugcugaucaacagauucaccaugaagcacaagaaggccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacguggugcccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcagauucugggagcugaucgacagagagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagaggcaacagccugagcggcguggagggcgagggccugcacagacugggcuacauccugagagacgugagcaagaaggagggcggcgccauguacgccgacgacaccgccggcugggacaccagaaucacccuggaggaccugaagaacgaggagauggugaccaaccacaugaagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcaucuucaagagcauccagcaccugaccgugaccgaggagaucgccgugcagaacuggcuggccagagugggcagagagagacugagcagaauggccaucagcggcgacgacugcguggugaagccccuggacgacagauucgccagcgcccugaccgcccugaacgacaugggcaaggugagaaaggacauccagcagugggagcccagcagaggcuggaacgacuggacccaggugcccuucugcagccaccacuuccacgagcuggugaugaaggacggcagagugcugguggugcccugcagaaaccaggacgagcugaucggcagagccagaaucagccagggcgccggcuggagccugaaggagaccgccugccugggcaagagcuacgcccagauguggacccugauguacuuccacagaagagaccugagacuggccgccaacgccaucugcagcgccgugcccagccacugggugcccaccagcagaaccaccuggagcauccacgccaagcacgaguggaugaccaccgaggacaugcuggccguguggaacagaguguggauccaggagaaccccuggauggaggacaagacccccguggagagcugggaggaggugcccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 17658 - RNA, 9876 nt, Artificial Sequence
  derived and/or modified CDS sequence (opt4) from DENV-2__GQ398272__SS-prME
accgccggcgugaucaucaugcugauccccaccgccauggccuuccaccugaccaccagaaacggcgagccccacaugaucgugggcagacaggagaagggcaagagccugcuguucaagaccgaggacggcgugaacaugugcacccugauggccaucgaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgugcagagaaucgagaccuggauccugagacaccccggcuucaccaucauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaacgaggagcaggacaagagauucaucugcaagcacagcaugguggacagaggcuggggcaacggcugcggccuguucggcaagggcggcaucgugaccugcgccauguucaccugcaagaagaacauggagggcaagguggugcugcccgagaaccuggaguacaccaucgugaucaccccccacagcggcgaggagcacgccgugggcaacgacaccggcaagcacggcaaggagaucaagaucaccccccagagcagcaucaccgaggccgagcugaccggcuacggcaccgugaccauggagugcagccccagaaccggccuggacuucaacgagauggugcugcugcagauggaggacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagaucgugaaggagaucgccgagacccagcacggcaccaucgugaucagagugcaguacgagggcgacggcagccccugcaagauccccuucgagaucauggaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcguggugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucagcaccaacaucuggcugaagcugagagagaagcaggacguguucugcgacagcaagcugaugagcgccgccaucaaggacaacagagccgugcacgccgacaugggcuacuggaucgagagcgcccugaacgacaccuggaagauggagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcaagcuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugauggccaccaucggcaucgcccugcugagccagagcaccauccccgagaccauccuggagcugaccgacgcccuggcccugggcaugauggugcugaagaucgugagaaacauggagaaguaccagcuggccgugaccaucauggccaucagcugcgugcccaacgccgugauccugcagaacgccuggaaggugagcugcaccauccuggccgccgugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccgugauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggcguguuccccgugagcauccccaucaccgccgccgccugguaccugugggaggugaagaagcagagagccggcgugcugugggacgugcccagccccccccccgugggcaaggccgagcuggaggacggcgccuacagaaucaagcagagaggcaucuucggcuacagccagaucggcgccggcguguacaaggagggcaccuuccacaccauguggcacgugaccagaggcgccgugcugaugcacagaggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucguggacagaaagggcaagguggugggccuguacggcaacggcguggugaccagaagcggcgccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagagccaacgacugggacuucguggugaccaccgacaucagcgagaugggcgccaacuucagagccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacagaguggccgccgagggcaucaacuacgccgacagaagauggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagagacgcccuggacaaccuggccgugcugcacaccgccgaggugggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucaucacccaggagagcgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcagaggcuggccccugagcaagauggacaucggcgugccccugcuggccaucggcugcuacagccaggugaaccccaucacccugaucgccgcccugcugcugcugguggcccacuacgccaucaucggccccggccugcaggccaaggccaccagagaggcccagaagagagccgccgccggcaucaugaagaaccccaccguggacggcaucaccgugaucgaccuggagcccauccccuacgaccccaaguucgagaagcagcugggccaggugaugcugcuggugcugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccaucgaggccggcagaacccugagagugcugaaccugguggagaacuggcugaacaacaacacccaguucugcaucaaggugcugaaccccuacaugcccagcgugaucgagaagauggagacccugcagagaaaguacggcggcgcccuggugagaaacccccugagcagaaacagcacccacgagauguacugggugagcaacgccaccggcaacaucgugagcagcgugaacaugaucagcagaaugcugaucaacagauucaccaugaagcacaagaaggccaccuacgagcccgacguggaccugggcagcggcaccagaaacaucggcaucgagaacgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacguggugcccauggugacccagauggccaugaccgacaccacccccuucggccagcagagaguguucaaggagaagguggacaccagaacccaggagcccaaggagggcaccaagaagcugaugagaaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcagauucugggagcugguggacagagagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagaggcaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacaugaagggcgagcacaagaagcuggccgaggccaucuucaagcugaccuaccagaacaagguggugagagugcagagacccacccccagaggcaccgugauggacaucaucagcagaaaggaccagagaggcagcggccaggugggcaccuacggccugaacaccuucaccaacauggaggcccagcugaucagacagauggagggcgagggcaucuucaagagcauccagcaccugaccgugaccgaggagaucgccgugcagaacuggcuggccagagugggcagagagagacugagcagaauggccaucagcggcgacgacugcguggugaagccccuggacgacagauucgccagcgcccugaccgcccugaacgacaugggcaaggugagaaaggacauccagcagugggagcccagcagaggcuggaacgacuggacccaggugcccuucugcagccaccacuuccacgagcuggugaugaaggacggcagagugcugguggugcccugcagaaaccaggacgagcugaucggcagagccagaaucagccagggcgccggcuggagccugaaggagaccgccugccugggcaagagcuacgcccagauguggacccugauguacuuccacagaagagaccugagacuggccgccaacgccaucugcagcgccgugcccagccacugggugcccaccagcagaaccaccuggagcauccacgccaagcacgaguggaugaccaccgaggacaugcuggccguguggaacagaguguggauccaggagaaccccuggauggaggacaagacccccguggagagcugggaggaggugcccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaaaggaggaggaggaggccggcgugcugugguga

SEQ ID NO: 17659 - RNA, 9876 nt, Artificial Sequence
  derived and/or modified CDS sequence (opt4) from DENV-2__GQ398292__SS-prME
accgccggcguguucaucaugcugauccccaccgccauggccuuccaccugaccaccagaaacggcgagccccacaugaucgugggcagacaggagaagggcaagagccugcuguucaagaccgaggacggcgugaacaugugcacccugauggccaucgaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgugcagagaaucgagaccuggaucaugagacaccccggcuucaccaucauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaacgaggagcaggacaagagauucgugugcaagcacagcaugguggacagaggcuggggcaacggcugcggccuguucggcaagggcggcaucgugaccugcgccauguucaccugcaagaagaacauggagggcaagguggugcugcccgagaaccuggaguacaccaucgugaucaccccccacagcggcgaggagcacgccgugggcaacgacaccggcaagcacggcaaggagaucaagaucaccccccagagcagcaucaccgaggccgagcugaccggcuacggcaccgugaccauggagugcagccccagaaccggccuggacuucaacgagauggugcugcugcagauggaggacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagaucgugaaggagaucgccgagacccagcacggcaccaucgugaucagagugcaguacgagggcgacggcagccccugcaagauccccuucgagaucauggaccuggagaagagacacgugcugggcagacugaucaccgugaaccccaucguggccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcguggugacccuguaccugggcgccauggugcaggccgacagcggcugcguggugagcuggaagagcaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucaccaccaacaucuggcugaagcugagagagaagcaggacguguucugcgacagcaagcugaugagcgccgccaucaaggacaacagagccgugcacgccgacaugggcuacuggaucgagagcgcccugaacgacaccuggaagauggagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcaagcuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccaugcugcugguggccgugagcuucgugacccugaucaccggcaacaugagcuucagagaccugggcagagugauggugauggugggcgccaccaugaccgacgacaucggcaugggcaucaccuaccuggcccugcuggccgccuucaaggugagacccaccuucgccgccggccugcugcugagaaagcugaccagcaaggagcugaugauggccaccaucggcaucgcccugcugagccagagcaccauccccgagaccauccuggagcugaccgacgcccuggcccugggcaugauggugcugaagaucgugagaaacauggagaaguaccagcuggccgugaccaucauggccaucagcugcgugcccaacgccgugauccugcagaacgccuggaaggugagcugcaccauccuggccgccgugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggcguguuccccgugagcauccccaucaccgccgccgccugguaccugugggaggugaagaagcagagagccggcgugcugugggacgugcccagccccccccccgugggcaaggccgagcuggaggacggcgccuacagaaucaagcagagaggcauccugggcuacagccagaucggcgccggcguguacaaggagggcaccuuccacaccauguggcacgugaccagaggcgccgugcugaugcacagaggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucguggacagaaagggcaagguggugggccuguacggcaacggcguggugaccagaagcggcgccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagagccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacagaguggccgccgagggcaucaacuacgccgacagaagauggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagagacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucgccacccaggagagcgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggagcccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccaucgaggccggcagaacccugagagugcugaaccugguggagaacuggcugaacaacaacacccaguucugcaucaaggugcugaaccccuacaugcccagcgugaucgagaagauggagacccugcagagaaaguacggcggcgcccuggugagaaacccccugagcagaaacagcacccacgagauguacugggugagcaacgccaccggcaacaucgugagcagcgugaacaugaucagcagaaugcugaucaacagauucaccaugaagcacaagaaggccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacguggugcccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcagauucugggagcugaucgacagagagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagaggcaacagccugagcggcguggagggcgagggccugcacagacugggcuacauccugagagacgugagcaagaaggagggcggcgccauguacgccgacgacaccgccggcugggacaccagaaucacccuggaggaccugaagaacgaggagauggugaccaaccacaugaagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcaucuucaagagcauccagcaccugaccgugaccgaggagaucgccgugcagaacuggcuggccagagugggcagagagagacugagcagaauggccaucagcggcgacgacugcguggugaagccccuggacgacagauucgccagcgcccugaccgcccugaacgacaugggcaaggugagaaaggacauccagcagugggagcccagcagaggcuggaacgacuggacccaggugcccuucugcagccaccacuuccacgagcuggugaugaaggacggcagagugcugguggugcccugcagaaaccaggacgagcugaucggcagagccagaaucagccagggcgccggcuggagccugaaggagaccgccugccugggcaagagcuacgcccagauguggacccugauguacuuccacagaagagaccugagacuggccgccaacgccaucugcagcgccgugcccagccacugggugcccaccagcagaaccaccuggagcauccacgccaagcacgaguggaugaccaccgaggacaugcuggccguguggaacagaguguggauccaggagaaccccuggauggaggacaagacccccguggagagcugggaggaggugcccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 17660 - RNA, 9876 nt, Artificial Sequence
  derived and/or modified CDS sequence (opt4) from DENV-2__GQ398267__SS-prME
accgccggcaucaucaucaugaugauccccaccgugauggccuuccaccugaccaccagaaacggcgagccccacaugaucgugagcagacaggagaagggcaagagccugcuguucaagaccgagaacggcgugaacaugugcacccugauggccauggaccugggcgagcugugcgaggacaccaucaccuacaacugcccccugcugagacagaacgagcccgaggacaucgacugcuggugcaacagcaccagcaccugggugaccuacggcaccugcaccgccaccggcgagcacagaagagagaagagaagcguggcccuggugccccacgugggcaugggccuggagaccagaaccgagaccuggaugagcagcgagggcgccuggaagcacgcccagagaaucgagaccuggauccugagacaccccggcuucaccaucauggccgccauccuggccuacaccaucggcaccaccuacuuccagagagugcugaucuucauccugcugaccgccgugacccccagcauggccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcaccccgccacccugagaaaguacugcguggaggccaagcugaccaacaccaccaccgccagcagaugccccacccagggcgagcccagccugaacgaggagcaggacaagagauucgugugcaagcacagcaugguggacagaggcuggggcaacggcugcggccuguucggcaagggcggcaucgugaccugcgccauguucaccugcaagaagaacauggagggcaagguggugcagcccgagaaccuggaguacaccaucgugaucaccccccacagcggcgaggagaacgccgugggcaacgacaccggcaagcacggcaaggagaucaaggugaccccccagagcagcaucaccgaggccgagcugaccggcuacggcaccgugaccauggagugcagccccagaaccggccuggacuucaacgagauggugcugcugcagauggagaacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucgugaucagagugcaguacgagggcgacggcagccccugcaagauccccuucgagaucauggaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugagcugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcguggugaucaccuggaucggcaugaacagcagaagcaccagccugagcgugagccuggugcuggugggcguggugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugaccgagaacgaggugaagcugaccaucaugaccggcgacaucaagggcaucaugcaggccggcaagagaagccugagaccccagcccaccgagcugaaguacagcuggaaggccuggggcaaggccaagaugcugagcaccgagcugcacaaccacaccuuccugaucgacggccccgagaccgccgagugccccaacaccaacagagccuggaacagccuggagguggaggacuacggcuucggcguguucaccaccaacaucuggcugaagcugaaggagagacaggacguguucugcgacagcaagcugaugagcgccgccaucaaggacaacagagccgugcacgccgacaugggcuacuggaucgagagcgcccugaacgacaccuggaagaucgagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcagacuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugaugaccaccaucggcaucgugcugcugagccagagcaccauccccgagagcauccuggagcugaccgacgcccuggcccugggcaugauggugcugaagaucgugagaaacauggagaaguaccagcuggccgugaccaucauggccauccugugcgugcccaacgccgugauccugcagaacgccuggaaggugagcugcaccacccuggccguggugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugagaugggaggagcaggccgagaucagcggcagcagccccauccugagcaucaccaucagcgaggacggcagcaugagcaucaagaacgaggaggaggagcagacccugaccauccugaucagaaccggccugcuggugaucagcggccuguuccccgugagcauccccaucaccgccgccgccugguaccugugggaggugaagaagcagagagccggcgugcugugggacgugcccagccccccccccgugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacaagggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucguggacaagaagggcaagguggugggccuguacggcaacggcguggugaccagaagcggcaccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccaucagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacaucaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagagugggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacagaguggccgccgagggcaucaacuacgccgacagaagauggugcuucgacggcgugaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccaagaacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggacuucggccugggcagcaucaccacccagcagcccgagagcaacauccuggacaucgaccugagacccgccagcgccuggacccuguacgccguggccaccaccuucaucacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaucgccgcccugcugcugcugguggcccacuacgccaucaucggccccggccugcaggccaaggccaccagagaggcccagaagagagccgccgccggcaucaugaagaaccccaccguggacggcaugaccgugaucgaccuggaccccauccccuacgaccccaaguucgagaagcagcugggccaggugaugcugcuggugcugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccgccaacaccagaagaggcaccggcaacaucggcgagacccugggcgagaaguggaagaacagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaaccuggugacccccgagggcaaggugguggaccugggcugcggcagaggcggcuggagcuacuacugcggcggccugaagaacgugaaggaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccguggaggccggcagaacccugagagugcugaaccugguggagaacuggcugaacaacaacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccagcggcaacaucgugagcagcgugaacaugaucagcagaaugcugaucaacagauucaccaugagacacaagaaggccaccuacgagcccgacguggaccugggcagcggcaccagaaacaucggcaucgagagcgagacccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacgugauccccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcggcuucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacauggagggcgagcacaagaagcuggccgaggccaucuucaagcugaccuaccagaacaagguggugagagugcagagacccacccccagaggcaccgugauggacaucaucagcagaagagaccagagaggcagcggccagguggugaccuacggccugaacaccuucaccaacauggaggcccagcugaucagacagauggagggcgagggcguguucaagagcauccagcagcugaccgugaaggaggagaucgccgugaagaacuggcugaucagagugggcagagagagacugagcagaauggccaucagcggcgacgacugcguggugaagccccuggacgacagauucgccagcgcccugaucgcccugaacgacaugggcaaggugagaaaggacauccagcagugggagcccagcagaggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugagagagaccgccugccugggcaagagcuacgcccagauguggagccugauguacuuccacagaagagaccugagacuggccgccaacgccaucugcagcgccgugcccagccacugggugcccaccagcagaaccaccuggagcauccacgccacccacgaguggaugaccaccgaggacaugcugaccguguggaacagaguguggauccaggagaaccccuggauggaggacaagacccccguggagagcugggaggagauccccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 17661 - RNA, 9876 nt, Artificial Sequence
  derived and/or modified CDS sequence (opt4) from DENV-2__GQ398266__SS-prME
accgccggcaucaucaucaugaugauccccaccgugauggccuuccaccugaccaccagaaacggcgagccccacaugaucgugagcagacaggagaagggcaagagccugcuguucaagaccgagaacggcgugaacaugugcacccugauggccauggaccugggcgagcugugcgaggacaccaucaccuacaacugcccccugcugagacagaacgagcccgaggacaucgacugcuggugcaacagcaccagcaccugggugaccuacggcaccugcaccgccaccggcgagcacagaagagagaagagaagcguggcccuggugccccacgugggcaugggccuggagaccagaaccgagaccuggaugagcagcgagggcgccuggaagcacgcccagagaaucgagaccuggauccugagacaccccggcuucaccaucauggccgccauccuggccuacaccaucggcaccaccuacuuccagagagugcugaucuucauccugcugaccgccgugacccccagcauggccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcaccccgccacccugagaaaguacugcguggaggccaagcugaccaacaccaccaccgccagcagaugccccacccagggcgagcccagccugaacgaggagcaggacaagagauucgugugcaagcacagcaugguggacagaggcuggggcaacggcugcggccuguucggcaagggcggcaucgugaccugcgccauguucaccugcaagaagaacauggagggcaagguggugcagcccgagaaccuggaguacaccaucgugaucaccccccacagcggcgaggagaacgccgugggcaacgacaccggcaagcacggcaaggagaucaaggugaccccccagagcagcaucaccgaggccgagcugaccggcuacggcaccgugaccauggagugcagccccagaaccggccuggacuucaacgagauggugcugcugcagauggagaacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucgugaucagagugcaguacgagggcgacggcagccccugcaagauccccuucgagaucauggaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugagcugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcguggugaucaccuggaucggcaugaacagcagaagcaccagccugagcgugagccuggugcuggugggcguggugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugaccgagaacgaggugaagcugaccaucaugaccggcgacaucaagggcaucaugcaggccggcaagagaagccugagaccccagcccaccgagcugaaguacagcuggaaggccuggggcaaggccaagaugcugagcaccgagcugcacaaccacaccuuccugaucgacggccccgagaccgccgagugccccaacaccaacagagccuggaacagccuggagguggaggacuacggcuucggcguguucaccaccaacaucuggcugaagcugaaggagagacaggacguguucugcgacagcaagcugaugagcgccgccaucaaggacaacagagccgugcacgccgacaugggcuacuggaucgagagcgcccugaacgacaccuggaagaucgagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcagacuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugaugaccaccaucggcaucgugcugcugagccagagcaccauccccgagagcauccuggagcugaccgacgcccuggcccugggcaugauggugcugaagaucgugagaaacauggagaaguaccagcuggccgugaccaucauggccauccugugcgugcccaacgccgugauccugcagaacgccuggaaggugagcugcaccacccuggccguggugagcgugagcccccugcugcugaccagcagccagcagaaggccgacuggaucccccuggcccugaccaucaagggccugaaccccaccgccaucuuccugaccacccugagcagaaccaacaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugagaugggaggagcaggccgagaucagcggcagcagccccauccugagcaucaccaucagcgaggacggcagcaugagcaucaagaacgaggaggaggagcagacccugaccauccugaucagaaccggccugcuggugaucagcggccuguuccccgugagcauccccaucaccgccgccgccugguaccugugggaggugaagaagcagagagccggcgugcugugggacgugcccagccccccccccgugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacaagggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucguggacaagaagggcaagguggugggccuguacggcaacggcguggugaccagaagcggcaccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccaucagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacaucaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagagugggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacagaguggccgccgagggcaucaacuacgccgacagaagauggugcuucgacggcgugaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccaagaacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggacuucggccugggcagcaucaccacccagcagcccgagagcaacauccuggacaucgaccugagacccgccagcgccuggacccuguacgccguggccaccaccuucaucacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaucgccgcccugcugcugcugguggcccacuacgccaucaucggccccggccugcaggccaaggccaccagagaggcccagaagagagccgccgccggcaucaugaagaaccccaccguggacggcaugaccgugaucgaccuggaccccauccccuacgaccccaaguucgagaagcagcugggccaggugaugcugcuggugcugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccgccaacaccagaagaggcaccggcaacaccggcgagacccugggcgagaaguggaagaacagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaaccuggugacccccgagggcaaggugguggaccugggcugcggcagaggcggcuggagcuacuacugcggcggccugaagaacgugaaggaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccguggaggccggcagaacccugagagugcugaaccugguggagaacuggcugaacaacaacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccagcggcaacaucgugagcagcgugaacaugaucagcagaaugcugaucaacagauucaccaugagacacaagaaggccaccuacgagcccgacguggaccugggcagcggcaccagaaacaucggcaucgagagcgagacccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacgugauccccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcggcuucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacauggagggcgagcacaagaagcuggccgaggccaucuucaagcugaccuaccagaacaagguggugagagugcagagacccacccccagaggcaccgugauggacaucaucagcagaagagaccagagaggcagcggccagguggugaccuacggccugaacaccuucaccaacauggaggcccagcugaucagacagauggagggcgagggcguguucaagagcauccagcagcugaccgugaaggaggagaucgccgugaagaacuggcugaucagagugggcagagagagacugagcagaauggccaucagcggcgacgacugcguggugaagccccuggacgacagauucgccagcgcccugaccgcccugaacgacaugggcaaggugagaaaggacauccagcagugggagcccagcagaggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugagagagaccgccugccugggcaagagcuacgcccagauguggagccugauguacuuccacagaagagaccugagacuggccgccaacgccaucugcagcgccgugcccagccacugggugcccaccagcagaaccaccuggagcauccacgccacccacgaguggaugaccaccgaggacaugcugaccguguggaacagaguguggauccaggagaaccccuggauggaggacaagacccccguggagagcugggaggagauccccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 17662 - RNA, 9876 nt, Artificial Sequence
  derived and/or modified CDS sequence (opt4) from DENV-2__GQ398265__SS-prME
accgccggcaucaucaucaugaugauccccaccgugauggccuuccaccugaccaccagaaacggcgagccccacaugaucgugagcagacaggagaagggcaagagccugcuguucaagaccgagaacggcgugaacaugugcacccugauggccauggaccugggcgagcugugcgaggacaccaucaccuacaacugcccccugcugagacagaacgagcccgaggacaucgacugcuggugcaacagcaccagcaccugggugaccuacggcaccugcaccgccaccggcgagcacagaagagagaagagaagcguggcccuggugccccacgugggcaugggccuggagaccagaaccgagaccuggaugagcagcgagggcgccuggaagcacgcccagagaaucgagaccuggauccugagacaccccggcuucaccaucauggccgccauccuggccuacaccaucggcaccaccuacuuccagagagugcugaucuucauccugcugaccgccgugacccccagcauggccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcaccccgccacccugagaaaguacugcguggaggccaagcugaccaacaccaccaccgccagcagaugccccacccagggcgagcccagccugaacgaggagcaggacaagagauucgugugcaagcacagcaugguggacagaggcuggggcaacggcugcggccuguucggcaagggcggcaucgugaccugcgccauguucaccugcaagaagaacauggagggcaagguggugcagcccgagaaccuggaguacaccaucgugaucaccccccacagcggcgaggagaacgccgugggcaacgacaccggcaagcacggcaaggagaucaaggugaccccccagagcagcaucaccgaggccgagcugaccggcuacggcaccgugaccauggagugcagccccagaaccggccuggacuucaacgagauggugcugcugcagauggagaacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucgugaucagagugcaguacgagggcgacggcagccccugcaagauccccuucgagaucauggaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugagcugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcguggugaucaccuggaucggcaugaacagcagaagcaccagccugagcgugagccuggugcuggugggcguggugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugaccgagaacgaggugaagcugaccaucaugaccggcgacaucaagggcaucaugcaggccggcaagagaagccugagaccccagcccaccgagcugaaguacagcuggaaggccuggggcaaggccaagaugcugagcaccgagcugcacaaccacaccuuccugaucgacggccccgagaccgccgagugccccaacaccaacagagccuggaacagccuggagguggaggacuacggcuucggcguguucaccaccaacaucuggcugaagcugaaggagagacaggacguguucugcgacagcaagcugaugagcgccgccaucaaggacaacagagccgugcacgccgacaugggcuacuggaucgagagcgcccugaacgacaccuggaagaucgagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcagacuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugaugaccaccaucggcaucgugcugcugagccagagcaccauccccgagagcauccuggagcugaccgacgcccuggcccugggcaugauggugcugaagaucgugagaaacauggagaaguaccagcuggccgugaccaucauggccauccugugcgugcccaacgccgugauccugcagaacgccuggaaggugagcugcaccacccuggccguggugagcgugagcccccugcugcugaccagcagccagcagaaggccgacuggaucccccuggcccugaccaucaagggccugaaccccaccgccaucuuccugaccacccugagcagaaccaacaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugagaugggaggagcaggccgagaucagcggcagcagccccauccugagcaucaccaucagcgaggacggcagcaugagcaucaagaacgaggaggaggagcagacccugaccauccugaucagaaccggccugcuggugaucagcggccuguuccccgugagcauccccaucaccgccgccgccugguaccugugggaggugaagaagcagagagccggcgugcugugggacgugcccagccccccccccgugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacaagggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucguggacaagaagggcaagguggugggccuguacggcaacggcguggugaccagaagcggcaccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccaucagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacaucaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagagugggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacagaguggccgccgagggcaucaacuacgccgacagaagauggugcuucgacggcgugaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccaagaacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggacuucggccugggcagcaucaccacccagcagcccgagagcaacauccuggacaucgaccugagacccgccagcgccuggacccuguacgccguggccaccaccuucaucacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaugaccgugaucgaccuggaccccauccccuacgaccccaaguucgagaagcagcugggccaggugaugcugcuggugcugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccgccaacaccagaagaggcaccggcaacaccggcgagacccugggcgagaaguggaagaacagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaaccuggugacccccgagggcaaggugguggaccugggcugcggcagaggcggcuggagcuacuacugcggcggccugaagaacgugaaggaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccguggaggccggcagaacccugagagugcugaaccugguggagaacuggcugaacaacaacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccagcggcaacaucgugagcagcgugaacaugaucagcagaaugcugaucaacagauucaccaugagacacaagaaggccaccuacgagcccgacguggaccugggcagcggcaccagaaacaucggcaucgagagcgagacccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacgugauccccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcggcuucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacauggagggcgagcacaagaagcuggccgaggccaucuucaagcugaccuaccagaacaagguggugagagugcagagacccacccccagaggcaccgugauggacaucaucagcagaagagaccagagaggcagcggccagguggugaccuacggccugaacaccuucaccaacauggaggcccagcugaucagacagauggagggcgagggcguguucaagagcauccagcagcugaccgugaaggaggagaucgccgugaagaacuggcugaucagagugggcagagagagacugagcagaauggccaucagcggcgacgacugcguggugaagccccuggacgacagauucgccagcgcccugaccgcccugaacgacaugggcaaggugagaaaggacauccagcagugggagcccagcagaggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugagagagaccgccugccugggcaagagcuacgcccagauguggagccugauguacuuccacagaagagaccugagacuggccgccaacgccaucugcagcgccgugcccagccacugggugcccaccagcagaaccaccuggagcauccacgccacccacgaguggaugaccaccgaggacaugcugaccguguggaacagaguguggauccaggagaaccccuggauggaggacaagacccccguggagagcugggaggagauccccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 17663 - RNA, 9876 nt, Artificial Sequence
  derived and/or modified CDS sequence (opt4) from DENV-2__KX702403__SS-prME
accgccggcgugaucgugaugcugauccccaccgccauggccuuccaccugaccaccagaaacggcgagccccacaugaucgugggcagacaggagaagggcaagagccugcuguucaagaccgaggacggcgugaacaugugcacccugauggccaucgaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgugcagagaaucgagaccuggauccugagacaccccggcuucaccaucauggccgccauccuggccuacaccaucggcaccacccacuuccagagagcccugauccugauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaacgaggagcaggacaagagauucaucugcaagcacagcaugguggacagaggcuggggcaacggcugcggccuguucggcaagggcggcaucgugaccugcgccauguucaccugcaagaagaacauggagggcaagaucgugcagcccgagaaccuggaguacaccaucgugaucaccccccacagcggcgaggagcacgccgugggcaacgacaccggcaagcacggcaaggagaucaagaucaccccccagagcagcaccaccgaggccgagcugaccggcuacggcaccgugaccauggagugcagccccagaaccggccuggacuucaacgagauggugcugcugcagauggaggacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagaucgugaaggagaucgccgagacccagcacggcaccaucgugaucagagugcaguacgagggcgacggcagccccugcaagauccccuucgagaucaccgaccuggagaagagacacgugcugggcagacugaucaccgugaaccccaucgugaccgagaaggacagccccgugaacaucgaggccgagccccccuucggcgacagcuacaucaucgugggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcguggugacccuguaccugggcgccauggugcaggccgacagcggcugcaucgugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucaccaccaacaucuggcugaagcugagagagaagcaggacguguucugcgacagcaagcugaugagcgccgccaucaaggacaacagagccgugcacgccgacaugggcuacuggaucgagagcgcccugaacgacaccuggaagauggagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcaagcuggagauggacuucgacuucugcgagggcaccaccgugguggugaccgaggacugcgagaagagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugguggcccugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugauggccaccaucggcaucgcccugcugagccagagcacccugcccgagaccauccuggagcugaccgacgcccuggcccugggcaugauggcccugaagaucgugagaaacauggagaaguaccagcuggccgugaccaucauggccaucagcugcgugcccaacgccgugauccugcagaacgccuggaaggugagcugcaccauccuggccgccgugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggcguguuccccgugagcauccccaucaccgccgccgccugguaccugugggaggugaagaagcagagagccggcgugcugugggacgugcccagccccccccccgugggcaaggccgagcuggaggacggcgccuacagaaucaagcagagaggcauccugggcuacagccagaucggcgccggcguguacaaggagggcaccuuccacaccauguggcacgugaccagaggcgccgugcugaugcacagaggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggcaucuucaagaccaacaccggcaccaucggcgccgugagccuggacuucagccccggcaccagcggcagccccaucguggacagaaagggcaagguggugggccuguacggcaacggcguggugaccagaagcggcgccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagagccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaaaguggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagaaacgcccuggacaaccuggccgugcugcacaccgccgaggugggcggcaaggccuacacccacgcccugagcgagcugcccgagacccuggagacccugcugcugcugacccugcuggccgccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggcuucggcagcaucaccacccaggagagcgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggagcccaucccccacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacgugggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccaucgaggccggcagaacccugagagugcugaaccugguggagaacuggcugaacaacaacacccaguucugcaucaaggugcugaaccccuacaugcccagcgugaucgagaagauggagacccugcagagaaaguacggcggcgcccuggugagaaacccccugagcagaaacagcacccacgagauguacugggugagcaacgccaccggcaacaucgugagcagcgugaacaugaucagcagaaugcugaucaacagauucaccaugaagcacaagaaggccaccuacgagcccgacguggaccugggcagcggcaccagaaacaucggcaucgagagcgagacccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacguggugcccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaaggagaagacccccagaaugugcaccagagaggaguucaccagaaaggugagaagcaacgccgcccugggcgccguguucaccgacgagaacaaguggaagagcgccagagaggccguggaggacggcagauucugggagcugguggacagagagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagaggcaacagccugagcggcguggagggcgagggccugcacagacugggcuacauccugagagaggugggcaagaaggagggcggcgccauguacgccgacgacaccgccggcugggacaccagaaucacccuggaggaccugaagaacgaggagauggugaccaaccacaugaagggcgagcacaagaagcuggccgaggccaucuucaagcugaccuaccagaacaagguggugagagugcagagacccacccccagaggcaccgugauggacaucaucagcagaaaggaccagagaggcagcggccaggugggcaccuacggccugaacaccuucaccaacauggaggcccagcugaucagacagauggagggcgagggcaucuucaagagcauccagcaccugaccgccaccgaggagaccgccgugcagaacuggcuggccagagugggcagagagagacugagcagaauggccaucagcggcgacgacugcguggugaagcccaucgacgacagauucgccagcgcccugaccgcccugaacgacaugggcaaggugagaaaggacauccagcagugggagcccagcagaggcuggaacgacuggacccaggugcccuucugcagccaccacuuccacgagcuggugaugaaggacggcagagugcugguggugcccugcagaaaccaggacgagcugaucggcagagccagaaucagccagggcgccggcuggagccugaaggagaccgccugccugggcaagagcuacgcccagauguggacccugauguacuuccacagaagagaccugagacuggccgccaacgccaucugcagcgccgugcccagccacugggugcccaccagcagaaccaccuggagcauccacgccaagcacgaguggaugaccaccgaggacaugcuggccguguggaacagaguguggauccaggagaaccccuggauggaggacaagacccccguggagagcugggaggaggugcccuaccugggcaagagagaggaccaguggugcggcagccugaucggccugaccagcagagccaccugggccaagaacauccagaccgccaucaaccaggugagaagccugaucggcaacgagggcuacaccgacuacaugcccagcaugaagagauucagaagagaggaggaggaggccggcgugcugugguga

SEQ ID NO: 17664 - RNA, 9876 nt, Artificial Sequence
  derived and/or modified CDS sequence (opt4) from DENV-2__KX702404__SS-prME
accgccggcgugaucgugaugcugauccccaccgccauggccuuccaccugaccaccagaaacggcgagccccacaugaucgugggcagacaggagaagggcaagagccugcuguucaagaccgaggacggcgugaacaugugcacccugauggccaucgaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgugcagagaaucgagaccuggauccugagacaccccggcuucaccaucauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaacgaggagcaggacaagagauucaucugcaagcacagcaugguggacagaggcuggggcaacggcugcggccuguucggcaagggcggcaucgugaccugcgccauguucaccugcaagaagaacauggagggcaagguggugcagcccgagaaccuggaguacaccaucgugaucaccccccacagcggcgaggagcacgccgugggcaacgacaccggcaagcacggcaaggagaucaagaucaccccccagagcagcaccaccgaggccgagcugaccggcuacggcaccgugaccauggagugcagccccagaaccggccuggacuucaacgagauggugcugcugcagauggaggacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucgugaucagagugcaguacgagggcgacggcagccccugcaagauccccuucgagaucaccgaccuggagaagagacacgugcugggcagacugaucaccgugaaccccaucgugaccgagaaggacagccccgugaacaucgaggccgagccccccuucggcgacagcuacaucaucgugggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcguggugacccuguaccugggcgccauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgagaucaagcugaccaucaugaccggcgacaucaagggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucaccaccaacaucuggcugaagcugagagagaagcaggacguguucugcgacagcaagcugaugagcgccgccaucaaggacaacagagccgugcacgccgacaugggcuacuggaucgagagcgcccugaacgacaccuggaagauggagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcaagcuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugguggcccugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugauggccaccaucggcaucgcccugcugagccagagcacccugcccgagaccauccuggagcugaccgacgcccuggcccugggcaugauggcccugaagaucgugagaaacauggagaaguaccagcuggccgugaccaucauggccaucagcugcgugcccaacgccgugauccugcagaacgccuggaaggugagcugcaccauccuggccgccgugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggcguguuccccgugagcauccccaucaccgccgccgccugguaccugugggaggugaagaagcagagagccggcgugcugugggacgugcccagccccccccccguggagaaggccgagcuggaggacggcgccuacagaaucaagcagagaggcauccugggcuacagccagaucggcgccggcguguacaaggagggcaccuuccacaccauguggcacgugaccagaggcgccgugcugaugcacagaggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggcaucuucaagaccaacaccggcaccaucggcgccgugagccuggacuucagccccggcaccagcggcagccccaucguggacagaaagggcaagguggugggccuguacggcaacggcguggugaccagaagcggcgccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagagccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaaaguggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagaaacgcccuggacaaccuggccgugcugcacaccgccgaggugggcggcaaggccuacacccacgcccugagcgagcugcccgagacccuggagacccugcugcugcugacccugcuggccgccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggcuucggcagcaucaccacccaggagagcgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggagcccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacgugggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccaucgaggccggcagaacccugagagugcugaaccugguggagaacuggcugaacaacaacacccaguucugcaucaaggugcugaaccccuacaugcccagcgugaucgagaagauggagacccugcagagaaaguacggcggcgcccuggugagaaacccccugagcagaaacagcacccacgagauguacugggugagcaacgccaccggcaacaucgugagcagcgugaacaugaucagcagaaugcugaucaacagauucaccaugaagcacaagaaggccaccuacgagcccgacguggaccugggcagcggcaccagaaacaucggcaucgagagcgagauccccaaccuggacaucgugggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacguggugcccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaaggagaagacccccagaaugugcaccagagaggaguucaccagaaaggugagaagcaacgccgcccugggcgccguguucaccaacgagaacaaguggaagagcgccagagaggccguggaggacggcagauucugggagcugguggacagagagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagaggcaacagccugagcggcguggagggcgagggccugcacagacugggcuacauccugagagaggugggcaagaaggagggcggcgccauguacgccgacgacaccgccggcugggacaccagaaucacccuggaggaccugaagaacgaggagauggugaccaaccacaugaagggcgagcacaagaagcuggccgaggccaucuucaagcugaccuaccagaacaagguggugagagugcagagacccacccccagaggcaccgugauggacaucaucagcagaaaggaccagagaggcagcggccaggugggcaccuacggccugaacaccuucaccaacauggaggcccagcugaucagacagauggagggcgagggcaucuucaagagcauccagcaccugaccgccaccgaggagaucgccgugcagaacuggcuggccagagugggcagagagagacugagcagaauggccaucagcggcgacgacugcguggugaagcccaucgacgacagauucgccagcgcccugaccgcccugaacgacaugggcaaggugagaaaggacauccagcagugggagcccagcagaggcuggaacgacuggacccaggugcccuucugcagccaccacuuccacgagcuggugaugaaggacggcagagugcugguggugcccugcagaaaccaggacgagcugaucggcagagccagaaucagccagggcgccggcuggagccugaaggagaccgccugccugggcaagagcuacgcccagauguggacccugauguacuuccacagaagagaccugagacuggccgccaacgccaucugcagcgccgugcccagccacugggugcccaccagcagaaccaccuggagcauccacgccaagcacgaguggaugaccaccgaggacaugcuggccguguggaacagaguguggauccaggagaaccccuggauggaggacaagacccccguggagagcugggaggaggugcccuaccugggcaagagagaggaccaguggugcggcagccugaucggccugaccagcagagccaccugggccaagaacauccagaccgccaucaaccaggugagaagccugaucggcaacgagggcuacaccgacuacaugcccagcaugaagagauucagaagagaggaggaggaggccggcgugcugugguga

SEQ ID NO: 17665 - RNA, 9873 nt, Artificial Sequence
  derived and/or modified CDS sequence (opt4) from DENV-2__JQ686088__SS-prME
accaccggcaugaucaucaugcugauccccaccgugauggccuuccaccugaccaccagaaacggcgagccccacaugaucgugagcagacaggacaagggcaagagccugcuguucaagaccaaggacggcaccaacaugugcacccugauggccauggaccugggcgagcugugcgaggacaccaucaccuacaagugccccuuccugaagcagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgcccagagaaucgagaccuggauccugagacaccccggcuucaccaucauggccgccauccuggccuacaccaucggcaccacccacuuccagagagugcugaucuucauccugcugaccgccguggcccccagcaugaccaugagaugcaucggcaucgccaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgacagcagaugccccacccagggcgagcccagccugaacgaggagcaggacaagagauucgugugcaagcacagcaugguggacagaggcuggggcaacggcugcggccuguucggcaagggcggcaucgugaccugcgccauguucaccugcaagaagaacaugaagggcaagaucgugcagcccgagaaccuggaguacaccaucgugaucaccccccacagcggcgaggagcacgccgugggcaacgacaccggcaagcacggcaaggaggugaagaucaccccccagagcagcaucaccgaggccgagcugaccggcuacggcaccgugaccauggagugcagccccagaaccggccuggacuucaacgagauggugcugcugcagauggaggacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucgugaucagagugcaguacgagggcgacggcagccccugcaagauccccuucgagaucauggaccuggagaagagacacgugcugggcagacugaucaccgugaaccccaucgugaccgagaaggacagacccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcaucgugacccuguaccugggcgugauggugcaggccgacagcggcugcguggugagcuggaagaacaaggagcugaagugcggcaacggcaucuucgugaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggugggcaagagaagccugcagccccagcccaccgagcugagauacagcuggaagaccuggggcaaggccaagaugcugagcaccgagcugcacaaccagaccuuccugaucgacggccccgagaccgccgagugccccaacaccaacagagccuggaacagccuggagguggaggacuacggcuucggcguguucaccaccaacaucuggcugaagcugagagagaagcaggacguguucugcgacagcaagcugaugagcgccgccaucaaggacaacagagccgugcacgccgacaugggcuacuggaucgagagcgcccugaacgacaccuggaagaucgagaaggccagcuucaucgaggugaagagcugccacuggcccaagagccacacccuguggagcaacggcgugcuggagagcgagaugaucauccccaagaaccuggccggccccgugagccagcacaacaacagacccggcuacuacacccagaccgccggccccuggcaccugggcaagcuggagauggacuucgacuucugcaagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcauccugggcauggcccuguuccuggaggagaugcugagaaccagagugggcaccaagcacgccauccugcugguggccgugagcuucgugacccugaucaccggcaacaugagcuucagagaccugggcagagugaucgugauggugggcgccaccaugaccgacgacaucggcaugggcgugaccuaccuggcccugcuggccgccuucaaggugagacccaccuucgccgccggccugcugcugagaaagcugaccagcaaggagcugaugaugaccaccaucggcaucgugcugcugagccagagcagcauccccgagaccauccuggagcugaccgacgcccuggcccugggcaugaugauccugaagauggugagaaacauggagaaguaccagcuggccgugaccaucauggccauccugugcgugcccaacgccgugauccugcagaacgccuggaaggugagcugcaccauccuggccguggugagcgugagcccccugcugcugaccagcagccagcagaaggccgacuggauccccaucgcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugaagugggaggaccaggccgagaucagcggcagcagccccauccugagcaucaccaucagcgaggacggcagcaugagcaucaagaacgaggaggaggagcagacccugaccauccugaucagaaccggccugcugguggugagcggccuguuccccgugagcgugcccaucaccgccgccgccugguaccugugggaggugaagaagcagagagccggcgugcugugggacgugcccagccccccccccgccggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacaagggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucguggacaagaagggcaagguggugggccuguacggcaacggcguggugaccagaagcggcgccuacgugagcgccaucgcccagaccgagaagagcaucgaggacaaccccgagaucgaggacgacaucuucagaaagagaagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccgugagauaccagacccccgccaucagagccgagcacaccggcagagagaucguggaccugaugugccacgccaccuucaccaugagacugcugagccccaucagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaagaccggcaacgacaucgccgccugccugagaaagaacggcaagagagugauccagcugagcagaaagaccuucgacagcgaguacaucaagaccagaaccaacgacugggacuucguggugaccaccgacaucagcgagaugggcgccaacuucaaggcccagagagugaucgaccccagaagaugcaugaagcccgugauccugaccgacggcgaggagagagugauccuggccggccccaugcccgugacccacagcagcgccgcccagagaggcagagugggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaagauggugcuucgacggcaccagaaacaaccagauccuggaggagaacguggagguggagaucuggaccaaggagggcgagagaaagaagcugaagcccagauggcuggacgccagaaucuacgccgacccccuggcccugaaggaguucaaggaguucgccgccggcagaaagagccugacccugaaccugaucaccgagaugggcagacugcccaccuucaugacccagaaggugagagacgcccuggacaaccuggccgugcugcacaccgccgaggccggcggcaaggccuacaaccacgcccugaacgagcugcccgagacccuggagacccugcugcugcugacccugcuggccaccgugaccggcggcaucuuccuguuccugaugagcggcagaggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucgugacccagcagcccgagagcaacauccuggacaucgaccugagacccgccagcgccuggacccuguacgccguggccaccaccuucaucacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccuguuccugcugguggcccacuacgccaucaucggccccggccugcaggccaaggccaccagagaggcccagaagagagccgccgccggcaucaugaagaaccccaccguggacggcaucaccgugaucgaccuggaccccauccccuacgaccccaaguucgagaagcagcugggccaggugaugcugcuggugcugugcgugacccaggugcugaugaugagaaccaccugggcccugugcgaggcccugacccuggccaccggccccgugagcacccugugggagggcaaccccggcagauucuggaacaccaccaucgccgugagcauggccaacaucuucagaggcagcuaccuggccggcgccggccugcuguucagcaucaugaagaacaccaccagcgccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaaccuggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaucccccccgagagaugcgacacccugcugugcgacaucggcgagagcagccccagccccaccguggaggccggcagaacccugagagugcugaaccugguggagaacuggcugagcaacaacacccaguucugcgugaaggugcugaaccccuacaugcccagcgugaucgagaagauggaggcccugcagagaaagcacggcggcgcccuggugagaaacccccugagcagaaacagcacccacgagauguacugggugagcaacgccagcggcaacaucgugagcagcgugaacaugaucagcagaaugcugaucaacagauucaccaugagacacaagaaggccaccuacgagcccgacguggaccugggcagcggcaccagaaacaucggcaucgagagcgagacccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacguggugcccauggugacccagauggccaugaccgacaccacccccuucggccagcagagaguguucaaggagaagguggacaccagaacccaggagcccaaggagggcaccaagaagcugaugagaaucaccgccgaguggcuguggaaggagcugggcaagaagaagacccccagaaugugcaccagagaggaguucaccaagaaggugagaagcaacgccgcccugggcgccaucuucaccgacgagaacaaguggaagagcgccagagaggccgugggcgacggcagauucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagaggugagcaagaaggagggcggcgccauguacgccgacgacaccgccggcugggacaccagaaucaccaucgaggaccugaagaacgaggagaugaucaccaaccacauggagggcgagcacaagaagcuggccgaggccaucuucagacugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcguguucaagagcauccagcaccugaccgccgccgaggagaucgccgugcagaacuggcuggugagagugggcagagagagacugagcagaauggccaucagcggcgacgacugcguggugaagccccuggacgacagauucgccagagcccugaccgcccugaacgacaugggcaaggugagaaaggacauccagcagugggagcccagcagaggcuggaacgacuggacccaggugcccuucugcagccaccacuuccacgagcugaucaugaaggacggcagaauccugguggugcccugcagaaaccaggacgagcugaucggcagagccagaaucagccagggcgccggcuggagccugagagagaccgccugccugggcaagagcuacgcccagauguggagccugauguacuuccacagaagagaccugagacuggccgccaacgccaucugcagcgccgugcccagccacugggugcccaccagcagaaccaccuggagcauccacgccagccacgaguggaugaccaccgaggacaugcugaccguguggaacagaguguggauccaggagaaccccuggauggaggacaagacccccguggagagcugggaggagauccccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 17666 - RNA, 9876 nt, Artificial Sequence
  derived and/or modified CDS sequence (opt4) from DENV-2__KF479233__SS-prME
accgccggcgugaucaucaugcugauccccaccgccauggccuuccaccugaccaccagaaacggcgagccccacaugaucgugagcagacaggagaagggcaagagccugcuguucaagaccgaggacggcgugaacaugugcacccugauggccauggaccugggcgagcugugcgaggacaccaucaccuacaacugcccccugcugagacagaacgagcccgaggacaucgacugcuggugcaacagcaccagcaccugggugaccuacggcaccugcaccgccaccggcgagcacagaagagagaagagaagcguggcccuggugccccacgugggcaugggccuggagaccagaaccgagaccuggaugagcagcgagggcgccuggaagcacgcccagagaaucgagaccuggauccugagacaccccggcuucaccaucauggccgccauccuggccuacaccaucggcaccaccuacuuccagagagugcugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgccagcagaugccccacccagggcgagcccagccugaacgaggagcaggacaagagauucgugugcaagcacagcaugguggacagaggcuggggcaacggcugcggccuguucggcaagggcggcaucgugaccugcgccauguucaccugcaagaagaacauggagggcaagaucgugcagcccgagaaccuggaguacaccaucguggugaccccccacagcggcgaggagaacgccgugggcaacgacaccggcaagcacggcaaggagaucaaggugaccccccagagcagcaucaccgaggccgagcugaccggcuacggcaccgugaccauggagugcagccccagaaccggccuggacuucaacgagauggugcugcugcagauggagaacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucguggugagagugcaguacgagggcgacggcagccccugcaagauccccuucgagaucauggaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugagcugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcguggugaucaccuggaucggcaugaacagcagaagcaccagccugagcgugagccuggugcuggugggcguggugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagccccagaaccagaccuuccugaucgacggccccgagaccgccgagugccccaacaccaacagagccuggaacagccuggagguggaggacuacggcuucggcguguucaccaccaacaucuggcugaagcugaaggagagacaggacguguucugcgacagcaagcugaugagcgccgccaucaaggacaacagagccgugcacgccgacaugggcuacuggaucgagagcgcccugaacgacaccuggaagaucgagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcaagcuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacaagggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccgugcugcugguggccgugagcuucaugacccugaucaccggcaacaugagcuucagagaccugggcagagugauggugauggugggcgccgccaugaccgacgacaucggcaugggcgugaccuaccuggcccugcuggccgccuucaaggugagacccaccuucgccgccggccugcugcugagaaagcugaccagcaaggagcugaugaugaccaccaucggcaucgugcugcugagccagagcaccauccccgagaccauccuggagcugaccgacgcccuggcccugggcaugaugauccugaagaucgugagaaacauggagaaguaccagcuggccgugaccaucauggccauccugugcgugcccaacgccgugauccugcagaacgccuggaaggugagcugcaccauccuggccguggugagcgugagcccccugcugcugaccagcagccagcagaaggccgacuggaucccccuggcccugaccaucaagggccugaaccccaccgccaucuuccugaccacccugagcagaaccaacaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugagaugggaggaccaggccgagaucagcggcagcagccccauccugagcaucaccaucagcgaggacggcagcaugagcaucaagaacgaggaggaggagcagacccugaccauccugaucagaaccggccugcuggugaucagcggccuguuccccgugagcauccccaucaccgccgccgccugguaccugugggaggugaagaagcagagagccggcgugcugugggacgugcccagccccccccccgugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacaagggcaagagaaucgagcccagcugggccgacgugagaaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucguggacaagaagggcaagguggugggccuguacggcaacggcguggugaccagaagcggcaccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacaucaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggagcugaugagaagaggcgaccugcccguguggcuggccuacagaguggccgccgagggcaucaacuacgccgacagaagauggugcuucgacggcaucaagaacaaccagauccuggaggagaacguggagguggagaucuggaccaaggagggcgagaagaagaagcugaagcccagauggcuggacgccagaaucuacagcgacccccuggcccugaaggaguucaaggaguucgccgccggcagaaagagccugaccaugaaccugaucaccgagaugggcagacugcccaccuucaugacccagaaggccagaaacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggacuucggccugggcagcaucgugacccagcagcccgagagcaacauccuggacaucgaccugagacccgccagcgccuggacccuguacgccguggccaccaccuucaucacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggaccccauccccuacgaccccaaguucgagaagcagcugggccaggugaugcugcuggugcugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccgccaacaccagaagaggcaccggcaacaccggcgagacccugggcgagaaguggaagaacagacugaacagccugggcaagagcgaguuccagaucuacaagagaagcggcauccaggagguggacagaacccuggccaaggagggcaucaagagaggcgagaccgaccaccacgccgugagcagaggcagcgccaagcugagaugguucguggagagaaaccuggugacccccgagggcaaggugauggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccguggaggccggcagaacccugagagugcugaaccugguggagaacuggcugaacaacaacacccaguucugcaucaaggugcugaaccccuacaugcccagcgugaucgagaagauggagacccugcagagaaaguacggcggcgcccuggugagaaacccccugagcagaaacagcacccacgagauguacugggugagcaacgccagcggcaacaucgugagcagcgugaacaugaucagcagaaugcugaucaacagauucaccaugagacacaagaaggccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacgugauccccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcagauucugggagcugguggacaaggagagaaaccugcaccuggagggcaagugcgagaccugcguguacaacaugaugggcaagagagagaagaagaucggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagaggugagcaagaaggagggcggcgccauguacgccgacgacaccgccggcugggacaccagaaucacccuggaggaccugaagaacgaggagauggugaccaaccacauggagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacaugggcgcccagcugaucagacagauggagggcgagggcguguucaagagcauccagcaccugaccaccaccgaggagguggccgugcaggacuggcuggccagagugggcagagagagacugagcagaauggccaucagcggcgacgacugcguggugaagccccuggacgacagauucgccagcgcccugaccgcccugaacgacaugggcaaggugagaaaggacauccagcagugggagcccagcagaggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugagagagaccgccugccugggcaagagcuacgcccagauguggagccugauguacuuccacagaagagaccugagacuggccgccaacgccaucugcagcgccgugcccagccacugggugcccaccagcagaaccaccuggagcauccacgccagacacgaguggaugaccaccgaggacaugcugaccguguggaacagaguguggauccaggagaaccccuggauggaggacaagacccccguggagagcugggaggagauccccuaccugggcaagagagaggaccaguggugcggcagccugaucggccugaccagcagagccaccugggccaagaacauccagaccgccaucaaccaggugagaagccugaucggcagcgaggaguacaccgacuacaugcccagcaugaagagauucagaagagaggaggaggaggccggcgugcugugguga

SEQ ID NO: 17667 - RNA, 9876 nt, Artificial Sequence
  derived and/or modified CDS sequence (opt4) from DENV-2__KX372564__SS-prME
accgccggcaucaucaucaugaugauccccaccgugauggccuuccaccugaccaccagaaacggcgagccccacaugaucgugagcagacaggagaagggcaagagccugcuguucaagaccgagaacggcgugaacaugugcacccugauggccauggaccugggcgagcugugcgaggacaccaucaccuacaacugcccccugcugagacagaacgagcccgaggacaucgacugcuggugcaacagcaccagcaccugggugaccuacggcaccugcaccgccaccggcgagcacagaagagagaagagaagcguggcccuggugccccacgugggcaugggccuggagaccagaaccgagaccuggaugagcagcgagggcgccuggaagcacgcccagagaaucgagaccugggugcugagacaccccggcuucaccaucauggccgccauccuggccuacaccaucggcaccaccuacuuccagagagugcugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcaccccgccacccugagaaaguacugcaucgaggccaagcugaccaacaccaccaccgccagcagaugccccacccagggcgagcccagccugaacgaggagcaggacaagagauucgugugcaagcacagcaugguggacagaggcuggggcaacggcugcggccuguucggcaagggcggcaucgugaccugcgccauguucaccugcaagaagaacauggagggcaagaucgugcagcccgagaaccuggaguacaccaucgugaucaccccccacagcggcgaggagaacgccgugggcaacgacaccggcaagcacggcaaggagaucaaggugaccccccagagcagcaucaccgaggccgagcugaccggcuacggcaccgugaccauggagugcagccccagaaccggccuggacuucaacgagauggugcugcugcagauggagaacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucgugaucagagugcaguacgagggcgacggcagccccugcaagauccccuucgagaucauggaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugagcugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcguggugaucaccuggaucggcaugaacagcagaagcaccagccugagcgugagccuggugcuggugggcguggugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugaccgagaacgaggugaagcugaccaucaugaccggcgacaucaagggcaucaugcaggccggcaagagaagccugagaccccagcccaccgagcugaaguacagcuggaaggccuggggcaaggccaaggugcugagcaccgagcugcacaaccacaccuuccugaucgacggccccgagaccgccgagugccccaacaccaacagagccuggaacagccuggagguggaggacuacggcuucggcguguucaccaccaacaucuggcugaagcugaaggagagacaggacgugagcugcgacagcaagcugaugagcgccgccaucaaggacaacagagccgugcacgccgacaugggcuacuggaucgagagcgcccugaacgacaccuggaagaucgagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcagacuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugaugaccaccaucggcaucgugcugcugagccagagcaccauccccgagaccauccuggagcugaccgacgcccuggcccugggcaugauggugcugaagaucgugagaaacauggagaaguaccagcuggccgugaccaucauggccauccugugcgugcccaacgccgugauccugcagaacgccuggaaggugagcugcaccgcccuggccguggugagcgugagcccccugcugcugaccagcagccagcagaagaccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagcuuccugaagaacgacauccccaugaccggcccccugguggccggcggccugcugaccgugugcuacgugcugaccggcagaagcgccgaccuggagcuggagagagccgccgacaucagaugggaggagcaggccgagaucagcggcagcagccccauccugagcaucaccaucagcgaggacggcagcaugagcaucaagaacgaggaggaggagcagacccugaccauccugaucagaaccggccugcuggugaucagcggccuguuccccgugagcauccccaucaccgccgccgccugguaccugugggaggugaagaagcagagagccggcgugcugugggacgugcccagccccccccccgugggcagagccgagcuggaggacggcgccuacagaaucaagcagaagggcauccugggcuacagccagaucggcgccggcguguacaaggagggcaccuuccacaccauguggcacgugaccagaggcgccgugcugaugcacaagggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucguggacaagaagggcaagguggugggccuguacggcaacggcguggugaccagaagcggcaccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccaucagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacaucaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagagugggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacagaguggccgccgagggcaucaacuacgccgacagaagauggugcuucgacggcgugaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagaaacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucgugaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggacuucggccugggcagcaucaccacccagcagcccgagagcaacauccuggacaucgaccugagacccgccagcgccuggacccuguacgccguggccaccaccuucaucacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggaccccauccccuacgaccccaaguucgagaagcagcugggccaggugaugcugcuggugcugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccgccaacaccagaagaggcaccggcaacaccggcgagacccugggcgagaaguggaagaacagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaaccuggugacccccgagggcaaggugguggaccugggcugcggcagaggcggcuggagcuacuacugcggcggccugaagaacgugaaggaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccguggaggccggcagaacccugagagugcugaaccugguggagaacuggcugaacaacaacacccaguucugcaucaaggugcugaaccccuacaugcccagcgugaucgagaagauggaggcccugcagagaagauacggcggcgcccuggugagaaacccccugagcagaaacagcacccacgagauguacugggugagcaacgccagcggcaacaucgugagcagcgugaacaugaucagcagaaugcugaucaacagauucaccaugagacacaagaaggccaccuacgagcccgacguggaccugggcagcggcaccagaaacaucggcaucgagagcgaggugcccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacgugauccccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcggcuucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacauggagggcgagcacaagaagcuggccgaggccaucuucagacugaccuaccagaacaagguggugagagugcagagacccacccccagaggcaccgugauggacaucaucagcagaagagaccagagaggcagcggccagguggugaccuacggccugaacaccuucaccaacauggaggcccagcugaucagacagauggagggcgagggcguguucaagagcauccagcaccugaccgccaccgaggagaucgccgugaagaacuggcuggugagagugggcagagagagacugagcagaauggccaucagcggcgacgacugcguggugaagcccuucgacgacagauucgccaacgcccugaccgcccugaacgacaugggcaaggugagaaaggacauccagcagugggagcccagcagaggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugagagagaccgccugccugggcaagagcuacgcccagauguggagccugauguacuuccacagaagagaccugagacuggccgccaacgccaucugcagcgccgugcccagccacugggugcccaccagcagaaccaccuggagcauccacgccacccacgaguggaugaccaccgaggacaugcugaccguguggaacagaguguggauccaggagaaccccuggauggaggacaagacccccguggagagcugggaggagauccccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 17668 - RNA, 9873 nt, Artificial Sequence
  derived and/or modified CDS sequence (opt4) from DENV-2__KX274130__SS-prME
agcgccgccacccugcugcugcuggugcccaccaucauggccuuccaccugaccaccagaaacggcgagccccacaugaucguggccagacacgagaagggcaagagccugaucuucaagaccgagaacggcgugaacaugugcacccugauggccauggaccugggcgagcugugcgaggagaccgugaccuacaagugccccuaccugaagcagagcgagcccgaggacaucgacugcuggugcaacaccaccagcaccugggugaccuacggcaccugcagcagcagcggcgagcacagaagagagaagagaagcguggcccuggccccccacgugggcaugggccuggagaccagaaccgagaccuggaugagcagcgagggcgccuggaagcacgcccagagaaucgagaacuggauccugagacaccccggcuacaccgugauggccgccgccaucgccauggccaucggcaccaacaacuuccagagagcccugaucuucgugcugcugaccgccguggcccccagcaugaccaugagaugcgugggcaucgccaacagagacuucguggagggcgugagcggcggcagcuggguggacaucgugcuggagcacggcagcugcgugaccaccauggccaagaacaagcccacccuggacuucgagcugaccaagaccgaggccaagcugcccgccacccugagaaaguacugcaucgaggccaagcugaccaacaccaccaccgagagcagaugccccacccagggcgagcccagccugcccgaggagcaggacaagagauucaucugcagacacagccugguggacagaggcuggggcaacggcugcggccuguucggcaagggcggcaucgugaccugcgccauguucaccugcaagaaguacauggagggcaagaucgugcagcccgagaaccuggaguacaccguggccgugaccccccacagcggcgaggagcacagcgugggcaacgacaccggcaagcacggccaggacgugaagaucaccccccagagcagcaucaccgagaccgcccuggagggcuacggcagcaucagcauggagugcagccccagaaccggccuggacuucaacgagauggugcugcugcagauggaggacaaggccuggcuggugcacagacagugguuccuggaccugccccugcccuggcugcccggcagcgacacccagggcagcaacugggugcagaaggagacccuggugaccuucaagaacccccacgccaagaagcaggacgugguggugcugggcagccaggagggcgccaugcacagcgcccugaccggcgccaccgagauccagaugaccagcggcaaccugcuguucaccggccaccugaagugcagacugagaauggacaagcuggagcugaagggcaugagcuacagcaugugcaccggcaaguucaagguggugaaggagaucgccgagacccagcacggcaccaucgugaucagagugcaguacgagggcgagggcagccccugcaagauccccuucgagaucauggaccuggagaagaagcacgugcugggcagacugaucaccgugaaccccaucaucaccgagaaggacaagcccaccaacaucgaggccgagccccccuucggcgacagcuacauccugaucggcguggagcccggccagcugaagaugaacugguucaagaagggcagcagcaucggccagauguucgagaccaccaugagaggcgccaagagaauggccauccugggcgacaccgccugggacuucggcagccugggcggcguguucaacagcaucggcaaggcccugcaccagguguucggcgccguguacaacgccgccuucagcggcgugagcuggaccaugaagauccugaucggcgugaucaucaccuggaucggcaugaacagcagaagcaccagcaugagcaucacccuggugauggugggccuggugacccuguaccugggcgugguggugcaggccgacagcggcugcguggugagcuggaagaccaaggagcugaagugcggcagcggcaucuucgugaccgacaacgugcacguguggaccgagcaguacaaguuccagcccgagagccccgccaagcuggccgccgccaucaagaaggcccacgaggagggcgugugcggcaucagaagcgugaccagacuggagaacaucauguggaagcagaucacccccgagcugaaccacauccugaccgagaacgacgugaaggugaccaucaugaccggcgacaucaagggcauccugcagcagggcagaagagcccugagaccccagcccaccgagcugaaguacagcuggaagagcuggggcaagagcaagaucgugagcagcgagacccacaaccagaccuuccugaucgacggccccgagaccaccgagugccccgacaccaacagagccuggaacagccuggagguggaggacuacggcuucggccuguucagcaccaacaucuggcugagacugagagagaagcaggacacccugugcgacagcaagcugaugagcgccgccgugaaggacgagagagccauccacgccgacaugggcuacuggaucgagagcaagcugaacggcagcuggaagaucgagaaggccagcuuccuggaggugaagagcugcaccuggcccagaagccacacccuguggagcaacggcgugcuggagagcgagaugaucauccccaagaaccugggcggccccgugagccagcacaacuacagacccggcuacuacacccagaccaccggccccuggcaccugggcaagcuggagauggacuucgacuacugcgagggcaccaccgugaucgugaccgaggagugcaacaacagaggccccagccugagaaccaccaccgccagcggcaagcugaucaccgaguggugcugcagaagcugcaccaugcccccccugagauucaagggcgaggacggcugcugguacggcauggagaucagaccccugaaggagaaggaggagaaccuggugaacagccuggugaccgccggccacggccagaucgacaacuucagccugggcauccugggcaucgcccuguuccuggaggaggugaugaagagcagaaucggcaucaagcacaccaucggcaugaccaucaucaccuuccugcugcuggugaccggcaacgugagcuacagagaccugggcagagugauccugauggugggcagcaccauggccgacgagaugggcaugggcgugaccuaccuggcccugcuggccaccuucagaaucagacccaccuucgcccuggcccugaugaucagaaagcugaccagcaaggagcugcugauggccaccaucggcaucgugcugaucgcccagugcgacgugcccggcaccauccuggagaucaccgacgccugcgcccugggccugaugcugcugaagaugaccagagagcuggagagauaccagcuggccgugacccugcugagccugaccugcauccccaacgccaccaucauguggggcgccuggaaggugaccugcaccauccugacccuggugagcauggccccccuguuccugaccaccagcagacagaagaccgacugggugcccguggcccugagcaucuacggccugaaccccaccgccaucuacuucaccacccuggccaaggccaagaagaucagaagcuggccccugaacgaggccgugauggccgugggcauggugagcauccuggccagcagccugcugagaaacgacauccccauggccggcccccugguggccggcggccugcugacccugugcuacgugcugaccggcagaagcgccgaccuggagcuggagaagagcgccgacaucaaguggaacgacgacgccgagaucagcggcagcagccccaucaucaacguggccgugagcgaggacggcagcaugagcaucaaggacgaggaggaggagaacacccugaccauccugaucagaaccggccugcuggccaucagcggcauguaccccauggccauccccgccaccgccgccgugugguacuucugggaggccagaaagcagagagccggcgugcugugggacgugcccagccccccccccaccggcaaggccgagcuggaggagggcgccuacagaaucaagcagagaggcaucuucggcuacagccagaucggcgccggcguguacaaggagggcaccuuccacaccauguggcacgugaccagaggcagcgugcugaugugcaagggcaagagacuggagcccagcugggccgacgugaagaaggaccugaucagcuacggcggcggcuggagacuggacggcgaguggaccgagggcgaggaggugcaggugcuggcccuggagcccggcaagaaccccagagccgugcagaccaagcccggcauguucaagaccgacaccggcagaaucggcgccgugagccuggacuucgcccccggcaccagcggcagccccaucaucgacaagaagggcaaggugaucggccuguacggcaacggcguggugaugaagagcggcgccuacgugagcagcaucgcccagaccgagaagagagaggacgagauccccgagaucgaggacgacaucuucagaaagagaagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucgccaccagaguggagaugggcgaggccgccggcaucuucaugaccgccaccccccccggcagcaaggaccccuucccccagagcaacgcccccaucauggacgaggagagagagauccccgagagaagcuggaacagcggccacgaguggaucaccgacuucgagggcaagaccgugugguucgugcccagcaucagagccggcaacgacaucgccaccugccugagaaagaacggcaagaaggugauccagcugagcagaaagaccuucgacaccgaguacaucaagaccagaaacaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccccagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccgccauguucggccccgagagagagaagaccgacgccaucgacggcgaguacagacugagaggcgagagcagaaagaccuucguggagcugaugagaagaggcgaccugcccguguggcuggccuacaagguggccagcgagggcuacagcuacgccgacagaagauggugcuucgagggcgugaagaacaaccagauccuggaggagaaccuggagguggagaucuggaccaaggagggcgagagaaagaagcugagacccaaguggcuggacgccagaaccuacagcgacccccaggcccugaaggacuucaaggaguucgccgccggcagaaagagcaccacccugaaccugaucgccgagcugggcagacugcccaccuacaugacccagaagaccagagacgcccuggacaaccuggccgugcugcacaccgccgaggagggcggcagagccuaccagcacgccaucagcgagcugcccgagacccuggagacccugcugcugcugugccugcuggccaccgugagcggcggcguguuccuguuccugaugagcggcaagggcaucggcaagaugagcaugggccugggcugcaucaucaccgccagcggccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugacccugguggccgccaccauggccaacgagaugggcuaccuggagaagaccaagaaggaccugggcuucggcaaccccuacguggccagccacgaggccgccauccuggacaucgaccugcaccccgccagcgccuggacccuguacgccguggccaccacccugaucacccccaugcugagacacagcaucgagaacagcagcaccaacgugagccugaccgccaucgccaaccaggccaccgugcugaugggccugggcaagggcuggccccugagcagaauggaccugggcgugccccugcuggcccugggcugcuacagccaggugaacccccugacccugaccgccagccugcugcugcugaucggccacuacgccaucaucggccccggccugcaggccaaggccaccagagaggcccagaagagaaccgccgccggcaucaugaagaaccccaccguggacggcaucaccgugaucgacaucgagcccauccccuacgaccccaaguucgagaagcagcugggccaggugaugcugcuggugcugugcguggcccaggugcugaugaugagaaccaccugggccaugugcgaggcccugaccaucgccaccggccccaucagcacccugugggagggcaaccccggcaaguucuggaacaccaccaucgccgugagcauggccaacaucuucagaggcagcuaccuggccggcgccggccugcuguucagcaucaugaagaacaccgugaccggcagaagaggcaccggcguggccggcgagacccugggcgagaaguggaagaucaagcugaacggccugggcagaaccgacuuccagaccuacaagagaagcggcaucaucgagguggacagaacccuggccaaggagggcaucaagagaggcgagaccaaccaccacgccgugagcagaggcagcgccaagcugagaugguucguggagagaaaccuggugaagcccgagggcaaggugaucgaccugggcugcggcagaggcggcuggagcuacuacugcggcggccugaagaacgugaccgaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccaucgaggccggcagaacccugagagugcugaacaugguggagaacuggcugggcaacaaccaguucugcaucaaggugcugaaccccuacaugcccagcgugaucgagaagauggagaaccugcagagaaaguucggcggcacccuggugagaaacccccugagcagaaacagcacccacgagauguacugggugagcaacgccagcggcaacaucgugagcagcgugaacaugaucagcagaaugcugaucaacagauucaccaugaagcacaagaagcccaccuacgagcaggacguggaccugggcagcggcaccagaaacgugggcaucgagaccgagaagcccaaccuggagaucaucggcaagagaaucgagaagaucaaggacgagcacaagcagaccuggcacuacgaccuggaccaccccuacaagaccugggccuaccacggcagcuacgagaccaagcagaccggcagcgccagcagcaugaucaacggcguggugaagcugcugaccaagcccugggacgugauccccauggugacccagauggccaugaccgacaccacccccuucggccagcagagaguguucaaggagaagguggacaccagaacccccgagcccaaggagggcaccaagaagcugaugaagcugaccgccaaguggcugugggccgagcugggcagacacaaggugcccagaaugugcaccagagacgaguucaccaacaaggugagaagcaacgccgccaugggcgccguguucaccgaggagaacagauggagcagcgccaaggaggccguggaggacgaggccuucugggaccugguggacagagagagaaagcugcaccugcagggcaagugcgagaccugcguguacaacaugaugggcaagagagagaagaagcugggcgaguucggcagagccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagagaucggcgccaaggacggcggcaugauguacgccgacgacaccgccggcugggacaccagagugaccgaggaggaccugaagaacgaggagaugaucagcgagcagaugaagggcgagcacagaacccuggccgaggccaucuucaagcugaccuaccagaacaagguggugagagugcagagacccacccccaagggcaccgugauggacaucaucagcagaagagaccagagaggcagcggccaggugggcaccuacggccugaacaccuucaccaacauggaggcccagcugaucagacagauggagggcgagggccuguucagagacaucagcaagcugaccauccaggaggagaccgccauccugaccuggcugaaggagaagggcagagacagacugagcagaauggccaucagcggcgacgacugcguggugaagcccguggacgacagauucgcccacgcccugaccgcccugaacgacaugggcaaggugagaaaggacauccagcagugggaggccagcaagggcuggaacgacuggacccaggugcccuucugcagccaccacuuccacgagaucaucaugaaggacggcagaaagcugguggugcccugcagaaaccaggacgagcugaucggcagagccagaaucagccagggcgccggcugggcccugaaggagaccgccugccugggcaaggccuacgcccagauguggagccugauguacuuccacagaagagaccugagacuggccgccaacgccaucugcagcgccgugcccagccacugggugcccaccagcagaaccaccuggagcauccacgcccaccaccaguggaugaccaccgaggacaugcuggacguguggaacagaguguggauccuggagaaccccuggauggacgacaagaccugcgugaagagcugggaggaggugcccuaccugggcaagagagaggaccaguggugcggcagccugaucggccugaccagcagagccaccugggccaagaacaucaagguggccaucgagcaggugagaagccugaucggcaaggaggaguacaccgacuacaugcccagcaugaagagauucaagcaggagcagagcaccgagggcgcccugugguga

SEQ ID NO: 17669 - RNA, 9876 nt, Artificial Sequence
  derived and/or modified CDS sequence (opt4) from DENV-2__GU289914__SS-prME
agcgccggcaugaucaucaugcugauccccaccgugauggccuuccaccugaccaccagaaacggcgagccccacaugaucgugagcagacaggagaagggcaagagccugcuguucaagaccgaggacggcgugaacaugugcacccugauggccauggaccugggcgagcugugcgaggacaccaucaccuacaacugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgcccagagaaucgagaccuggauccugagacaccccggcuucaccaucauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaacgaggagcaggacaagagauucgugugcaagcacagcaugguggacagaggcuggggcaacggcugcggccuguucggcaagggcggcaucgugaccugcgccauguucaccugcaagaagaacauggagggcaagguggugcagcccgagaaccuggaguacaccaucguggugaccccccacagcggcgaggagcacgccgugggcaacgacaccggcaagcacggcaaggagaucaaggugaccccccagagcagcaucaccgaggccgagcugaccggcuacggcaccgugaccauggagugcagccccagaaccggccuggacuucaacgagauggugcugcugcagauggagaacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucgugaucagagugcaguacgagggcgacggcagccccugcaagauccccuucgagaucauggaccuggagaagagacacgugcugggcagacugaucaccgugaaccccaucgugaccgagaaggacagccccgugaacaucgaggccgagccccccuucggcgacagcuacaucaucaucggcguggaccccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcaucgugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccaggaggagggcaucugcggcaucagaagcgugaccagacuggagaaccugauguggaagcagaucacccccgagcugaaccacauccuggccgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucaccaccaacaucuggcugaagcugaaggagaagcaggacgccuucugcgacagcaagcugaugagcgccgccaucaaggacaacagagccgugcacgccgacaugggcuacuggaucgagagcgcccugaacgacaccuggaagaucgagaaggccagcuucaucgaggugaagaacugccacuggcccaagagccacacccuguggagcaacggcgugcuggagagcgagaugaucauccccaagaaccuggccggccccgugagccagcacaacuacagacccggcuaccacacccagaucgccggccccuggcaccugggcaagcuggagauggacuucgacuucugcgacggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagguggacaacuucagccugggcgugcugggcauggcccuguuccuggaggagaugcugagaaccagagugggcaccaagcacgccauccugcugguggccgugagcuucgugacccugaucaccggcaacaugagcuucagagaccugggcagagugguggugauggugggcgccaccaugaccgacgacaucggcaugggcgugaccuaccuggcccugcuggccgccuucaaggugagacccaccuucgccgccggccugcugcugagaaagcugaccagcaaggagcugaugaugaccaccaucggcaucgugcugcugagccagagcaccauccccgagaccauccuggagcugaccgacgcccuggcccugggcaugauggugcugaagauggugagaaacauggagaaguaccagcuggccgugaccaucauggccauccugugcgugcccaacgccgugauccugcagaacgccuggaaggugagcugcaccauccuggccguggugagcgugagcccccugcugcugaccagcagccagcagaagaccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggccuguuccccgugagcauccccaucaccgccgccgccugguaccugugggaggugaagaagcagagagccggcgugcugugggacgugcccagccccccccccaugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacaagggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucagaaccaacgccggcaccaucggcgccgugagccuggacuucagccccggcaccagcggcagccccaucaucgacaagaagggcaagguggugggccuguacggcaacggcguggugaccagaagcggcgccuacgugagcgccaucgcccagaccgagaagagcaucgaggacaaccccgagaucgaggacgacaucuucagaaagagaagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucaucgacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaagauggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagagacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcagaggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucgccacccagcagcccgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggaccccauccccuacgaccccaaguucgagaagcagcugggccaggugaugcugcuggugcugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaucccccccgagaagugcgacacccugcugugcgacaucggcgagagcagccccaaccccaccguggaggccggcagaacccugagagugcugaaccugguggagaacuggcugaacaacaacacccaguucugcaucaaggugcugaaccccuacaugcccagcgugaucgagaagauggagacccugcagagaaaguacggcggcgcccuggugagaaacccccugagcagaaacagcacccacgagauguacugggugagcaacgccagcggcaacaucgugagcagcgugaacaugaucagcagaaugcugaucaacagauucaccaugagacacaagaaggccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacguggugcccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcagauucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacauggagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcguguucaagaacauccagcaccugaccgugaccgaggagaucgccgugcagaacuggcuggccagagugggcagagagagacugagcagaauggccaucagcggcgacgacugcguggugaagccccuggacgacagauucgccagcgcccugaccgcccugaacgacaugggcaagaucagaaaggacauccagcagugggagcccagcagaggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugagagagaccgccugccugggcaagagcuacgcccagauguggagccugauguacuuccacagaagagaccugagacuggccgccaacgccaucugcagcgccgugcccagccacugggugcccaccagcagaaccaccuggagcauccacgccaagcacgaguggaugaccaccgaggacaugcugaccguguggaacagaguguggauccaggagaaccccuggauggaggacaagacccccguggagagcugggaggagauccccuaccugggcaagagagaggaccaguggugcggcagccugaucggccugaccagcagagccaccugggccaagaacauccaggccgccaucaaccaggugagaagccugaucggcaacgaggaguacaccgacuacaugcccagcaugaagagauucagaagagaggaggaggaggccggcgugcugugguga

SEQ ID NO: 17670 - RNA, 9876 nt, Artificial Sequence
  derived and/or modified CDS sequence (opt4) from DENV-2__AY858036__SS-prME
accgccggcaucaucaucaugaugauccccaccgugauggccuuccaccugaccaccagaaacggcgagccccacaugaucgugagcagacaggagaagggcaagagccugcuguucaagaccgagaacggcgugaacaugugcacccugauggccauggaccugggcgagcugugcgaggacaccaucaccuacaacugcccccugcugagacagaacgagcccgaggacaucgacugcuggugcaacagcaccagcaccugggugaccuacggcaccugcaccgccaccggcgagcacagaagagagaagagaagcguggcccuggugccccacgugggcaugggccuggagaccagaaccgagaccuggaugagcagcgagggcgccuggaagcacgcccagagaaucgagaccugggugcugagacaccccggcuucaccaucauggccgccauccuggccuacaccaucggcaccaccuacuuccagagagugcugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcaccccgccacccugagaaaguacugcaucgaggccaagcugaccaacaccaccaccgccagcagaugccccacccagggcgagcccagccugaacgaggagcaggacaagagauucgugugcaagcacagcaugguggacagaggcuggggcaacggcugcggccuguucggcaagggcggcaucgugaccugcgccauguucaccugcaagaagaacauggagggcaagaucgugcagcccgagaaccuggaguacaccaucgugaucaccccccacagcggcgaggagaacgccgugggcaacgacaccggcaagcacggcaaggagaucaaggugaccccccagagcagcaucaccgaggccgagcugaccggcuacggcaccgugaccauggagugcagccccagaaccggccuggacuucaacgagauggugcugcugcagauggagaacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucgugaucagagugcaguacgagggcgacggcagccccugcaagauccccuucgagaucauggaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugagcugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcguggugaucaccuggaucggcaugaacagcagaagcaccagccugagcgugagccuggugcuggugggcguggugacccuguaccugggcgugauggugcaggccgacagcggcugcguggugagcuggaagaacaaggagcugaagugcggcagcggcaucuucgugaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagcugcacaaccacaccuuccugaucgacggccccgagaccgccgagugccccaacaccaacagagccuggaacagccuggagguggaggacuacggcuucggcguguucaccaccaacaucuggcugaagcugaaggagagacaggacguguucugcgacagcaagcugaugagcgccgccaucaaggacaacagagccgugcacgccgacaugggcuacuggaucgagagcgcccugaacgacaccuggaagaucgagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcagacuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugaugaccaccaucggcaucgugcugcugagccagagcaccauccccgagaccauccuggagcugaccgacgcccuggcccugggcaugauggugcugaagaucgugagaaacauggagaaguaccagcuggccgugaccaucauggccauccugugcgugcccaacgccgugauccugcagaacgccuggaaggugagcugcaccacccuggccguggugagcgugagcccccugcugcugaccagcagccagcagaaggccgacuggaucccccuggcccugaccaucaagggccugaaccccaccgccaucuuccugaccacccuggccagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugagaugggaggagcaggccgagaucagcggcagcagccccauccugagcaucaccaucagcgaggacggcagcaugagcaucaagaacgaggaggaggagcagacccugaccauccugaucagaaccggccugcuggugaucagcggccuguuccccgugagcauccccaucaccgccgccgccugguaccugugggaggugaagaagcagagagccggcgugcugugggacgugcccagccccccccccgugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacaagggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucguggacaagaagggcaagguggugggccuguacggcaacggcguggugaccagaagcggcaccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccaucagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacaucaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagagugggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacagaguggccgccgagggcaucaacuacgccgacagaagauggugcuucgacggcgugaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagaaacgcccuggacaaccuggccgugcugcacaccgccgagaccggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggacuucggccugggcagcaucaccacccagcagcccgagagcaacauccuggacaucgaccugagacccgccagcgccuggacccuguacgccguggccaccaccuucaucacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggaccccauccccuacgaccccaaguucgagaagcagcugggccaggugaugcugcuggugcugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccgccaacaccagaagaggcaccggcaacaccggcgagacccugggcgagaaguggaagaacagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaaccuggugacccccgagggcaaggugguggaccugggcugcggcagaggcggcuggagcuacuacugcggcggccugaagaacgugaaggaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccguggaggccggcagaacccugagagugcugaaccugguggagaacuggcugaacaacaacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccagcggcaacaucgugagcagcgugaacaugaucagcagaaugcugaucaacagauucaccaugagacacaagaaggccaccuacgagcccgacguggaccugggcagcggcaccagaaacaucggcaucgagagcgagacccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacgugauccccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcgaguucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacauggagggcgagcacaagaagcuggccgaggccaucuucagacugaccuaccagaacaagguggugagagugcagagacccacccccagaggcaccgugauggacaucaucagcagaagagaccagagaggcagcggccagguggugaccuacggccugaacaccuucaccaacauggaggcccagcugaucagacagauggagggcgagggcguguucaagagcauccagcaccugaccgugaccgaggagaucgccgugaagaacuggcuggugagagugggcagagagagacugagcagaauggccaucagcggcgacgacugcguggugaagccccuggacgacagauucgccagcgcccugaccgcccugaacgacaugggcaaggugagaaaggacauccagcagugggagcccagcagaggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugagagagaccgccugccugggcaagagcuacgcccagauguggagccugauguacuuccacagaagagaccugagacuggccgccaacgccaucugcagcgccgugcccagccacugggugcccaccagcagaaccaccuggagcauccacgccacccacgaguggaugaccaccgaggacaugcugaccguguggaacagaguguggauccaggagaaccccuggauggaggacaagacccccguggagagcugggaggagauccccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 17671 - RNA, 9876 nt, Artificial Sequence
  derived and/or modified CDS sequence (opt4) from DENV-2__HQ332184__SS-prME
accgccggcgugaucaucaugcugauccccaccgccauggccuuccaccugaccaccagaaacggcgagccccacaugaucgugggcagacaggagaagggcaagagccugcuguucaagaccgaggacggcgugaacaugugcacccugauggccaucgaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgugcagagaaucgagaccuggauccugagacaccccggcuucaccaucauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaacgaggagcaggacaagagauucaucugcaagcacagcaugguggacagaggcuggggcaacggcugcggccuguucggcaagggcggcaucgugaccugcgccauguucaccugcaagaagaacauggagggcaagguggugcagcccgagaaccuggaguacaccaucgugaucaccccccacagcggcgaggagcacgccgugggcaacgacaccggcaagcacggcaaggagaucaagaucaccccccagagcagcaucaccgaggccgagcugaccggcuacggcaccgugaccauggagugcagccccagaaccggccuggacuucaacgagauggugcugcugcagauggaggacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagaucgugaaggagaucgccgagacccagcacggcaccaucgugaucagaauccaguacgagggcgacggcagccccugcaagauccccuucgagaucaccgaccuggagaagagacacgugcugggcagacugaucaccgugaaccccaucgugaucgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccggcugggacuucggcagccugggcggcguguucaccagcaucggcaaggcccugcaccagguguucggcgccaucuacggcgccgccuucagcggcgugagcuggaccaugaagauccugaucggcguggugaucaccuggaucggcaugaacagcagaagcaccagccugagcgugagccuggugcuggugggcguggugacccuguaccugggcgccauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaccaagggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucaccaccaacaucuggcugaagcugagagagaagcaggacguguucugcgacagcaagcugaugagcgccgccaucaaggacaacagagccgugcacgccgacaugggcuacuggaucgagagcgcccugaacgacaccuggaagauggagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcaagcuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccacccugcugguggccgccagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugauggccaccaucggcaucacccugcugagccagagcaccauccccgagaccauccuggagcugaccgacgcccuggcccugggcaugauggugcugaagaucgugagaaacauggagaaguaccagcuggccgugaccaucauggccaucagcugcgugcccaacgccgugauccugagaaacgccuggaaggugagcugcaccauccuggccgccgugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggcguguuccccgugagcauccccaucaccgccgccgccugguaccugugggaggugaagaagcagagagccggcgugcugugggacgugcccagccccccccccgugggcaaggccgagcuggaggacggcgccuacagaaucaagcagagaggcauccugggcuacagccagaucggcgccggcguguacaaggagggcaccuuccacaccauguggcacgugaccagaggcgccgugcugaugcacagaggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggcaucuucaagaccaacaccggcaccaucggcgccgugagccuggacuucagccccggcaccagcggcagccccaucguggacagaaagggcaagguggugggccuguacggcaacggcguggugaccagaagcggcgccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucaaggccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagagccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaaaguggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagaaacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcgugcugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucaccacccaggagagcgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggagcccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccaucgaggccggcagaacccugagagugcugaaccugguggagaacuggcugaacaacaacacccaguucugcaucaaggugcugaaccccuacaugcccagcgugaucgagaagauggagacccugcagagaaaguacggcggcgcccuggugagaaacccccugagcagaaacagcacccacgagauguacugggugagcaacgccaccggcaacaucgugagcagcgugaacaugaucagcagaaugcugaucaacagauucaccaugaagcacaagaaggccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacguggugcccauggugacccagauggccaugaccgacaccacccccuucggccagcagagaguguucaaggagaagguggacaccagaacccaggagcccaaggagggcaccaagaagcugaugagaaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacggcagauucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagaggcaacagccugagcggcguggagggcgagggccugcacagacugggcuacauccugagagacgugggcaagaaggagggcggcgccauguacgccgacgacaccgccggcugggacaccagaaucacccuggaggaccugaagaacgaggagauggugaccaaccacaugaagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcaucuucaagagcauccagcaccugaccgccaccgaggagaucgccgugcagaacuggcuggccagagugggcagagagagacugagcagaauggccaucagcggcgacgacugcguggugaagcccaucgacgacagauucgccagcgcccugaccgcccugaacgacaugggcaaggugagaaaggacauccagcagugggagcccagcagaggcuggaacgacuggacccaggugcccuucugcagccaccacuuccacgagcuggugaugaaggacggcagagugcugguggugcccugcagaaaccaggacgagcugaucggcagagccagaaucagccagggcgccggcuggagccugaaggagaccgccugccugggcaagagcuacgcccagauguggacccugauguacuuccacagaagagaccugagacuggccgccaacgccaucugcagcgccgugcccagccacugggugcccaccagcagaaccaccuggagcauccacgccaagcacgaguggaugaccaccgaggacaugcuggccguguggaacagaguguggauccaggagaaccccuggauggaggacaagacccccguggagagcugggaggaggugcccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 17672 - RNA, 9876 nt, Artificial Sequence
  derived and/or modified CDS sequence (opt4) from DENV-2__HQ332185__SS-prME
accgccggcgugaucaucaugcugauccccaccgccauggccuuccaccugaccaccagaaacggcgagccccacaugaucgugggcagacaggagaagggcaagagccugcuguucaagaccgaggacggcgugaacaugugcacccugauggccaucgaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgugcagagaaucgagaccuggauccugagacaccccggcuucaccaucauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaacgaggagcaggacaagagauucaucugcaagcacagcaugguggacagaggcuggggcaacggcugcggccuguucggcaagggcggcaucgugaccugcgccauguucaccugcaagaagaacauggagggcaagguggugcagcccgagaaccuggaguacaccaucgugaucaccccccacagcggcgaggagcacgccgugggcaacgacaccggcaagcacggcaaggagaucaagaucaccccccagagcagcaucaccgaggccgagcugaccggcuacggcaccgugaccauggagugcagccccagaaccggccuggacuucaacgagauggugcugcugcagauggaggacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagaucgugaaggagaucgccgagacccagcacggcaccaucgugaucagaauccaguacgagggcgacggcagccccugcaagauccccuucgagaucaccgaccuggagaagagacacgugcugggcagacugaucaccgugaaccccaucgugaucgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcguggugaucaccuggaucggcaugaacagcagaagcaccagccugagcgugagccuggugcuggugggcguggugacccuguaccugggcgccauggugcaggccgacagcggcugcguggugagcuggaagaucaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaccaagggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucaccaccaacaucuggcugaagcugagagagaagcaggacguguucugcgacagcaagcugaugagcgccgccaucaagaacaacagagccgugcacgccgacaugggcuacuggaucgagagcgcccugaacgacaccuggaagauggagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcaagcuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugauggccaccaucggcaucacccugcugagccagagcaccauccccgagaccauccuggagcugaccgacgcccuggcccugggcaugauggugcugaagaucgugagaaacauggagaaguaccagcuggccgugaccaucauggccaucagcugcgugcccaacgccgugauccugagaaacgccuggaaggugagcugcaccauccuggccgccgugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggcguguuccccgugagcauccccaucaccgccgccgccugguaccugugggaggugaagaagcagagagccggcgugcugugggacgugcccagccccccccccgugggcaaggccgagcuggaggacggcgccuacagaaucaagcagagaggcauccugggcuacagccagaucggcgccggcguguacaaggagggcaccuuccacaccauguggcacgugaccagaggcgccgugcugaugcacagaggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggcaucuucaagaccaacaccggcaccaucggcgccgugagccuggacuucagccccggcaccagcggcagccccaucguggacagaaagggcaagguggugggccuguacggcaacggcguggugaccagaagcggcgccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucaaggccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagagccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaaaguggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagaaacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcgugcugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucaccacccaggagagcgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggagcccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccaucgaggccggcagaacccugagagugcugaaccugguggagaacuggcugaacaacaacacccaguucugcaucaaggugcugaaccccuacaugcccagcgugaucgagaagauggagacccugcagagaaaguacggcggcgcccuggugagaaacccccugagcagaaacagcacccacgagauguacugggugagcaacgccaccggcaacaucgugagcagcgugaacaugaucagcagaaugcugaucaacagauucaccaugaagcacaagaaggccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacguggugcccauggugacccagauggccaugaccgacaccacccccuucggccagcagagaguguucaaggagaagguggacaccagaacccaggagcccaaggagggcaccaagaagcugaugagaaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacggcagauucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagaggcaacagccugagcggcguggagggcgagggccugcacagacugggcuacauccugagagacgugggcaagaaggagggcggcgccauguacgccgacgacaccgccggcugggacaccagaaucacccuggaggaccugaagaacgaggagauggugaccaaccacaugaagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcaucuucaagagcauccagcaccugaccgccaccgaggagaucgccgugcagaacuggcuggccagagugggcagagagagacugagcagaauggccaucagcggcgacgacugcguggugaagcccaucgacgacagauucgccagcgcccugaccgcccugaacgacaugggcaaggugagaaaggacauccagcagugggagcccagcagaggcuggaacgacuggacccaggugcccuucugcagccaccacuuccacgagcuggugaugaaggacggcagagugcugguggugcccugcagaaaccaggacgagcugaucggcagagccagaaucagccagggcgccggcuggagccugaaggagaccgccugccugggcaagagcuacgcccagauguggacccugauguacuuccacagaagagaccugagacuggccgccaacgccaucugcagcgccgugcccagccacugggugcccaccagcagaaccaccuggagcauccacgccaagcacgaguggaugaccaccgaggacaugcuggccguguggaacagaguguggauccaggagaaccccuggauggaggacaagacccccguggagagcugggaggaggugcccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 17673 - RNA, 9876 nt, Artificial Sequence
  derived and/or modified CDS sequence (opt4) from DENV-2__HQ332186__SS-prME
accgccggcgugaucgugaugcugauccccaccgccauggccuuccaccugaccaccagaaacggcgagccccacaugaucgugggcagacaggagaagggcaagagccugcuguucaagaccgaggacggcgugaacaugugcacccugauggccaucgaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgugcagagaaucgagaccuggauccugagacaccccggcuucaccaucauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaacgaggagcaggacaagagauucaucugcaagcacagcaugguggacagaggcuggggcaacggcugcggccuguucggcaagggcggcaucgugaccugcgccauguucaccugcaagaagaacauggagggcaagguggugcagcccgagaaccuggaguacaccaucgugaucaccccccacagcggcgaggagcacgccgugggcaacgacaccggcaagcacggcaaggagaucaagaucaccccccagagcagcaucaccgaggccgagcugaccggcuacggcaccgugaccauggagugcagccccagaaccggccuggacuucaacgagauggugcugcugcagauggaggacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagaucgugaaggagaucgccgagacccagcacggcaccaucgugaucagagugcaguacgagggcgacggcagccccugcaagauccccuucgagaucaccgaccuggagaagagacacgugcugggcagacugaucaccgugaaccccaucgugaucgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcguggugaucaccuggaucggcaugaacagcagaagcaccagccugagcgugagccuggugcuggugggcguggugacccuguaccugggcgccauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaccaagggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucaccaccaacaucuggcugaagcugagagagaagcaggacguguucugcgacagcaagcugaugagcgccgccaucaaggacaacagagccgugcacgccgacaugggcuacuggaucgagagcgcccugaacgacaccuggaagauggagaaggccagcuucaucgaggugaagagcugccacuggcccaagagccacaccuucuggagcaacggcgugcuggagagcgagaugaucauccccaagaacuucgccggccccgugagccagcacaacuacagacccggcuaccacacccagaucgccggccccuggcaccugggcaagcuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugauggccaccaucggcaucacccugcugagccagagcaccauccccgagaccauccuggagcugaccgacgcccuggcccugggcaugauggugcugaagaucgugagaaacauggagaaguaccagcuggccgugaccaucauggccaucagcugcgugcccaacgccgugauccugagaaacgccuggaaggugagcugcaccauccuggccgccgugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggcguguuccccgugagcauccccaucaccgccgccgccugguaccugugggaggugaagaagcagagagccggcgugcugugggacgugcccagccccccccccgugggcaaggccgagcuggaggacggcgccuacagaaucaagcagagaggcauccugggcuacagccagaucggcgccggcguguacaaggagggcaccuuccacaccauguggcacgugaccagaggcgccgugcugaugcacagaggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggcaucuucaagaccaacaccggcaccaucggcgccgugagccuggacuucagccccggcaccagcggcagccccaucguggacagaaagggcaagguggugggccuguacggcaacggcguggugaccagaagcggcgccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucaaggccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagagccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaaaguggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagaaacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcgugcugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucaccacccaggagcccgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggagcccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccaucgaggccggcagaacccugagagugcugaaccugguggagaacuggcugaacaacaacacccaguucugcaucaaggugcugaaccccuacaugcccagcgugaucgagaagauggagacccugcagagaaaguacggcggcgcccuggugagaaacccccugagcagaaacagcacccacgagauguacugggugagcaacgccaccggcaacaucgugagcagcgugaacaugaucagcagaaugcugaucaacagauucaccaugaagcacaagaaggccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccacaccuacaagaccugggccuaccacggcagcuacgagaccaagcagaccggcagcgccagcagcauggugaacggcguggugagacugcugaccaagcccugggacguggugcccauggugacccagauggccaugaccgacaccacccccuucggccagcagagaguguucaaggagaagguggacaccagaacccaggagcccaaggagggcaccaagaagcugaugagaaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacggcagauucugggagcugguggacagagagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagaggcaacagccugagcggcguggagggcgagggccugcacagacugggcuacauccugagagacgugggcaagaaggagggcggcgccauguacgccgacgacaccgccggcugggacaccagaaucacccuggaggaccugaagaacgaggagauggugaccaaccacaugaagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcaucuucaagagcauccagcaccugaccgugaccgaggagaucgccgugcagaacuggcuggccagagugggcagagagagacugagcagaauggccaucagcggcgacgacugcguggugaagcccaucgacgacagauucgccagcgcccugaccgcccugaacgacaugggcaaggugagaaaggacauccagcagugggagcccagcagaggcuggaacgacuggacccaggugcccuucugcagccaccacuuccacgagcuggugaugaaggacggcagagugcugguggugcccugcagaaaccaggacgagcugaucggcagagccagaaucagccagggcgccggcuggagccugaaggagaccgccugccugggcaagagcuacgcccagauguggacccugauguacuuccacagaagagaccugagacuggccgccaacgccaucugcagcgccgugcccagccacugggugcccaccagcagaaccaccuggagcauccacgccaagcacgaguggaugaccaccgaggacaugcuggccguguggaacagaguguggauccaggagaaccccuggauggaggacaagacccccguggagagcugggaggaggugcccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 17674 - RNA, 9876 nt, Artificial Sequence
  derived and/or modified CDS sequence (opt4) from DENV-2__HQ332187__SS-prME
accgccggcgugaucaucaugcugauccccaccgccauggccuuccaccugaccaccagaaacggcgagccccacaugaucgugggcagacaggagaagggcaagagccugcuguucaagaccgaggacggcgugaacaugugcacccugauggccaucgaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgugcagagaaucgagaccuggauccugagacaccccggcuucaccaucauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaacgaggagcaggacaagagauucaucugcaagcacagcaugguggacagaggcuggggcaacggcugcggccuguucggcaagggcggcaucgugaccugcgccauguucaccugcaagaagaacauggagggcaagguggugcagcccgagaaccuggaguacaccaucgugaucaccccccacagcggcgaggagcacgccgugggcaacgacaccggcaagcacggcaaggagaucaagaucaccccccagagcagcaucaccgaggccgagcugaccggcuacggcaccgugaccauggagugcagccccagaaccggccuggacuucaacgagauggugcugcugcagauggaggacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagaucgugaaggagaucgccgagacccagcacggcaccaucgugaucagaauccaguacgagggcgacggcagccccugcaagauccccuucgagaucaccgaccuggagaagagacacgugcugggcagacugaucaccgugaaccccaucgugaucgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcguggugaucaccuggaucggcaugaacagcagaagcaccagccugagcgugagccuggugcuggugggcguggugacccuguaccugggcgccauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaccaagggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucaccaccaacaucuggcugaagcugagagagaagcaggacguguucugcgacagcaagcugaugagcgccgccaucaaggacaacagagccgugcacgccgacaugggcuacuggaucgagagcgcccugaacgacaccuggaagauggagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcaagcuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugauggccaccaucggcaucacccugcugagccagagcaccauccccgagaccauccuggagcugaccgacgcccuggcccugggcaugaugauccugaagaucgugagaaacauggagaaguaccagcuggccgugaccaucauggccaucagcugcgugcccaacgccgugauccugagaaacgccuggaaggugagcugcaccauccuggccgccgugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggcguguuccccgugagcauccccaucaccgccgccgccugguaccugugggaggugaagaagcagagagccggcgugcugugggacgugcccagccccccccccgugggcaaggccgagcuggaggacggcgccuacagaaucaagcagagaggcauccugggcuacagccagaucggcgccggcguguacaaggagggcaccuuccacaccauguggcacgugaccagaggcgccgugcugaugcacagaggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggcaucuucaagaccaacaccggcaccaucggcgccgugagccuggacuucagccccggcaccagcggcagccccaucguggacagaaagggcaagguggugggccuguacggcaacggcguggugaccagaagcggcgccuacgugagcgccaucgcccagaccgagaagagcaucgaggacaaccccgagaucgaggacgacaucuucagaaagaagagacugaccaucauggaccugcaccccggcgccggcaagaccaagagauaccugcccgugaucgugagagaggccaucaagagaggccugagaacccugauccuggcccccaccagagugguggccgccgagauggaggaggcccugagaggccugcccaucagauaccagacccccgccaucaaggccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagagccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaaaguggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagaaacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcgugcugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucaccacccaggagagcgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggagcccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccaucgaggccggcagaacccugagagugcugaaccugguggagaacuggcugaacaacaacacccaguucugcaucaaggugcugaaccccuacaugcccagcgugaucgagaagauggagacccugcagagaaaguacggcggcgcccuggugagaaacccccugagcagaaacagcacccacgagauguacugggugagcaacgccaccggcaacaucgugagcagcgugaacaugaucagcagaaugcugaucaacagauucaccaugaagcacaagaaggccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacguggugcccauggugacccagauggccaugaccgacaccacccccuucggccagcagagaguguucaaggagaagguggacaccagaacccaggagcccaaggagggcaccaagaagcugaugagaaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacggcagauucggcgagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagaggcaacagccugagcggcguggagggcgagggccugcacagacugggcuacauccugagagacgugggcaagaaggagggcggcgccauguacgccgacgacaccgccggcugggacaccagaaucacccuggaggaccugaagaacgaggagauggugaccaaccacaugaagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcaucuucaagagcauccagcaccugaccgccaccgaggagaucgccgugcagaacuggcuggccagagugggcagagagagacugagcagaauggccaucagcggcgacgacugcguggugaagcccaucgacgacagauucgccagcgcccugaccgcccugaacgacaugggcaaggugagaaaggacauccagcagugggagcccagcagaggcuggaacgacuggacccaggugcccuucugcagccaccacuuccacgagcuggugaugaaggacggcagagugcugguggugcccugcagaaaccaggacgagcugaucggcagagccagaaucagccagggcgccggcuggagccugaaggagaccgccugccugggcaagagcuacgcccagauguggacccugauguacuuccacagaagagaccugagacuggccgccaacgccaucugcagcgccgugcccagccacugggugcccaccagcagaaccaccuggagcauccacgccaagcacgaguggaugaccaccgaggacaugcuggccguguggaacagaguguggauccaggagaaccccuggauggaggacaagacccccguggagagcugggaggaggugcccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 17675 - RNA, 9876 nt, Artificial Sequence
  derived and/or modified CDS sequence (opt4) from DENV-2__HQ332188__SS-prME
accgccggcgugaucgugaugcugauccccaccgccauggccuuccaccugaccaccagaaacggcgagccccacaugaucgugggcagacaggagaagggcaagagccugcuguucaagaccgaggacggcgugaacaugugcacccugauggccaucgaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgugcagagaaucgagaccuggauccugagacaccccggcuucaccaucauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaacgaggagcaggacaagagauucaucugcaagcacagcaugguggacagaggcuggggcaacggcugcggccuguucggcaagggcggcaucgugaccugcgccauguucaccugcaagaagaacauggagggcaagguggugcagcccgagaaccuggaguacaccaucgugaucaccccccacagcggcgaggagcacgccgugggcaacgacaccggcaagcacggcaaggagaucaagaucaccccccagagcagcaucaccgaggccgagcugaccggcuacggcaccgugaccauggagugcagccccagaaccggccuggacuucaacgagauggugcugcugcagauggaggacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagaucgugaaggagaucgccgagacccagcacggcaccaucgugaucagagugcaguacgagggcgacggcagccccugcaagauccccuucgagaucaccgaccuggagaagagacacgugcugggcagacugaucaccgugaaccccaucgugaucgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcguggugaucaccuggaucggcaugaacagcagaagcaccagccugagcgugagccuggugcuggugggcguggugacccuguaccugggcgccauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaccaagggcgugaugcaggccggcaagagaagccugagaccccagcccaccgagcugaaguacagcuggaagaccuggggcaaggccaagaugcugagcaccgagagccacaaccagaccuuccugaucgacggccccgagaccaccgagugccccaacaccaacagagccuggaacagccuggagguggaggacuacggcuucggcguguucaccaccaacaucuggcugaagcugagagagaagcaggacguguucugcgacagcaagcugaugagcgccgccaucaaggacaacagagccgugcacgccgacaugggcuacuggaucgagagcgcccugaacgacaccuggaagauggagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaucgccggccccuggcaccugggcaagcuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugguggccgugagcuucgugacccugaucaccggcaacaugagcuucagagaccugggcagagugauggugauggugggcgccaccaugaccgacgacaucggcaugggcgccaccuaccuggcccugcuggccgccuucaaggugagacccaccuucgccgccggccugcugcugagaaagcugaccagcaaggagcugaugauggccaccaucggcaucacccugcugagccagagcaccauccccgagaccauccuggagcugaccgacgcccuggcccugggcaugauggugcugaagaucgugagaaacauggagaaguaccagcuggccgugaccaucauggccaucagcugcgugcccaacgccgugauccugagaaacgccuggaaggugagcugcaccauccuggccgccgugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggcguguuccccgugagcauccccaucaccgccgccgccugguaccugugggaggugaagaagcagagagccggcgugcugugggacgugcccagccccccccccgugggcaaggccgagcuggaggacggcgccuacagaaucaagcagagaggcauccugggcuacagccagaucggcgccggcguguacaaggagggcaccuuccacaccauguggcacgugaccagaggcgccgugcugaugcacagaggcaagagaaucgagcccagcugggccgacgugaagaaggaccugaucagcuacggcggcggcuggaagcuggagggcgaguggaaggagggcgaggagauccaggugcuggcccuggagcccggcaagaaccccagagccgugcagaccaagcccggcaucuucaagaccaacaccggcaccaucggcgccgugagccuggacuucagccccggcaccagcggcagccccaucguggacagaaagggcaagguggugggccuguacggcaacggcguggugaccagaagcggcgccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucaaggccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagagccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaaaguggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagaaacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcgugcugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucaccacccaggagcccgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggagcccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccaucgaggccggcagaacccugagagugcugaaccugguggagaacuggcugaacaacaacacccaguucugcaucaaggugcugaaccccuacaugcccagcgugaucgagaagauggagacccugcagagaaaguacggcggcgcccuggugagaaacccccugagcagaaacagcacccacgagauguacugggugagcaacgccaccggcaacaucgugagcagcgugaacaugaucagcagaaugcugaucaacagauucaccaugaagcacaagaaggccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacguggugcccauggugacccagauggccaugaccgacaccacccccuucggccagcagagaguguucaaggagaagguggacaccagaacccaggagcccaaggagggcaccaagaagcugaugagaaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacggcagauucugggagcugguggacagagagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagaggcaacagccugagcggcguggagggcgagggccugcacagacugggcuacauccugagagacgugggcaagaaggagggcggcgccauguacgccgacgacaccgccggcugggacaccagaaucacccuggaggaccugaagaacgaggagauggugaccaaccacaugaagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcaucuucaagagcauccagcaccugaccgugaccgaggagaucgccgugcagaacuggcuggccagagugggcagagagagacugagcagaauggccaucagcggcgacgacugcguggugaagcccaucgacgacagauucgccagcgcccugaccgcccugaacgacaugggcaaggugagaaaggacauccagcagugggagcccagcagaggcuggaacgacuggacccaggugcccuucugcagccaccacuuccacgagcuggugaugaaggacggcagagugcugguggugcccugcagaaaccaggacgagcugaucggcagagccagaaucagccagggcgccggcuggagccugaaggagaccgccugccugggcaagagcuacgcccagauguggacccugauguacuuccacagaagagaccugagacuggccgccaacgccaucugcagcgccgugcccagccacugggugcccaccagcagaaccaccuggagcauccacgccaagcacgaguggaugaccaccgaggacaugcuggccguguggaacagaguguggauccaggagaaccccuggauggaggacaagacccccguggagagcugggaggaggugcccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 17676 - RNA, 9876 nt, Artificial Sequence
  derived and/or modified CDS sequence (opt4) from DENV-2__HQ332189__SS-prME
accgccggcgugaucgugaugcugauccccaccgccauggccuuccaccugaccaccagaaacggcgagccccacaugaucgugggcagacaggagaagggcaagagccugcuguucaagaccgaggacggcgugaacaugugcacccugauggccaucgaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgugcagagaaucgagaacuggauccugagacaccccggcuucaccaucauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaacgaggagcaggacaagagauucaucugcaagcacagcaugguggacagaggcuggggcaacggcugcggccuguucggcaagggcggcaucgugaccugcgccauguucaccugcaagaagaacauggagggcaagguggugcagcccgagaaccuggaguacaccaucgugaucaccccccacagcggcgaggagcacgccgugggcaacgacaccggcaagcacggcaaggagaucaagaucaccccccagagcagcaucaccgaggccgagcugaccggcuacggcaccgugaccauggagugcagccccagaaccggccuggacuucaacgagauggugcugcugcagauggaggacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagaucgugaaggagaucgccgagacccagcacggcaccaucgugaucagagugcaguacgagggcgacggcagccccugcaagauccccuucgagaucaccgaccuggagaagagacacgugcugggcagacugaucaccgugaaccccaucgugaucgagaaggacagccccgugaacaucgaggccgagccccccuucggcgacagcuacgugaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcguggugaucaccuggaucggcaugaacagcagaagcaccagccugagcgugagccuggugcuggugggcguggugacccuguaccugggcgccauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaccaagggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucaccaccaacaucuggcugaagcugagagagaagcaggacguguucugcgacagcaagcugaugagcgccgccaucaaggacaacagagccgugcacgccgacaugggcuacuggaucgagagcgcccugaacgacaccuggaagauggagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcaagcuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugauggccaccaucggcaucacccugcugagccagagcaccauccccgagaccauccuggagcugaccgacgcccuggcccugggcaugauggugcugaagaucgugagaaacauggagaaguaccagcuggccgugaccaucauggccaucagcugcgugcccaacgccgugauccugagaaacgccuggaaggugagcugcaccauccuggccgccgugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggcguguuccccgugagcauccccaucaccgccgccgccugguaccugugggaggugaagaagcagagagccggcgugcugugggacgugcccagccccccccccgugggcaaggccgagcuggaggacggcgccuacagaaucaagcagagaggcauccugggcuacagccagaucggcgccggcguguacaaggagggcaccuuccacaccauguggcacgugaccagaggcgccgugcugaugcacagaggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggcaucuucaagaccaacaccggcaccaucggcgccgugagccuggacuucagccccggcaccagcggcagccccaucguggacagaaagggcaagguggugggccuguacggcaacggcguggugaccagaagcggcgccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucaaggccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagagccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaaaguggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagaaacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcgugcugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucaccacccaggagagcgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggagcccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccagccccaccaucgaggccggcagaacccugagagugcugaaccugguggaggacuggcugaacaacaacacccaguucugcaucaaggugcugaaccccuacaugcccagcgugaucgagaagauggagacccugcagagaaaguacggcggcgcccuggugagaaacccccugagcagaaacagcacccacgagauguacugggugagcaacgccaccggcaacaucgugagcagcgugaacaugaucagcagaaugcugaucaacagauucaccaugaagcacaagaaggccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccacaccuacaagaccugggccuaccacggcagcuacgagaccaagcagaccggcagcgccagcagcauggugaacggcguggugagacugcugaccaagcccugggacguggugcccauggugacccagauggccaugaccgacaccacccccuucggccagcagagaguguucaaggagaagguggacaccagaacccaggagcccaaggagggcaccaagaagcugaugagaaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacggcagauucugggagcugguggacagagagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagaggcaacagccugagcggcguggagggcgagggccugcacagacugggcuacauccugagagacgugggcaagaaggagggcggcgccauguacgccgacgacaccgccggcugggacaccagaaucacccuggaggaccugaagaacgaggagauggugaccaaccacaugaagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcaucuucaagagcauccagcaccugaccgccaccgaggagaucgccgugcagaacuggcuggccagagugggcagagagagacugagcagaauggccaucagcggcgacgacugcguggugaagcccaucgacgacagauucgccagcgcccugaccgcccugaacgacaugggcaaggugagaaaggacauccagcagugggagcccagcagaggcuggaacgacuggacccaggugcccuucugcagccaccacuuccacgagcuggugaugaaggacggcagagugcugguggugcccugcagaaaccaggacgagcugaucggcagagccagaaucagccagggcgccggcuggagccugaaggagaccgccugccugggcaagagcuacgcccagauguggacccugauguacuuccacagaagagaccugagacuggccgccaacgccaucugcagcgccgugcccagccacugggugcccaccagcagaaccaccuggagcauccacgccaagcacgaguggaugaccaccgaggacaugcuggccguguggaacagaguguggauccaggagaaccccuggauggaggacaagacccccguggagagcugggaggaggugcccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 17677 - RNA, 9876 nt, Artificial Sequence
  derived and/or modified CDS sequence (opt4) from DENV-2__JN368476__SS-prME
agcgccggcaugaucaucaugcugauccccaccgugauggccuuccaccugaccaccagaaacggcgagccccacaugaucgugggcauccaggagaagggcaagagccugcuguucaagaccgaggacggcgugaacaugugcacccugauggccauggaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgcccagagaaucgagaccuggauccugagacaccccggcuucaccaucauggccgccauccuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgagagcagaugccccacccagggcgagcccagccugaaggaggagcaggacaagagauucgugugcaagcacagcaugguggacagaggcuggggcaacggcugcggccuguucggcaagggcggcaucgugaccugcgccauguucaccugcaagaagaacauggagggcaagaucgugcagcccgagaaccuggaguacaccaucguggugaccccccacagcggcgaggagcacgccgugggcaacgacaccggcaagcacggcaaggagaucaaggugaccccccagagcagcaucaccgaggccgagcugaccggcuacggcaccgugaccauggagugcagccccagaaccggccuggacuucaacgagauggugcugcugcagauggagagcaaggccuggcuggugcacagacagugguuccuggaccugccccugcccuggcugcccggcgccgacaagcagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucgugaucagagugcaguacgagggcgacggcagccccugcaagauccccuucgagaucauggaccuggagaagagauacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcaucgugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccaggaggagggcaucugcggcaucagaagcgugaccagacuggagaaccugauguggaagcagaucacccccgagcugaaccacauccuggccgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucaccaccaacaucuggcugaagcugaaggagaagcaggacgccuucugcgacagcaagcugaugagcgccgccaucaaggacaacagagccgugcacgccgacaugggcuacuggaucgagagcgcccugaacgacaccuggaagaucgagaaggccagcuucaucgaggugaagaacugccacuggcccaagagccacacccuguggagcaacggcgugcuggagagcgagaugaucauccccaagaaccuggccggccccgugagccagcacaacuacagacccggcuaccacacccagaccgccggccccuggcaccugggcaagcuggagauggacuucgacuucugcgacggcaccaccgugaucgugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagguggacaacuucagccugggcgugcugggcauggcccuguuccuggaggagaugcugagaaccagagugggcaccaagcacgccauccugcugguggccgugagcuucgugacccugaucaccggcaacaugagcuucaaggaccugggcagagugguggugauggugggcaccaccaugaccgacgacaucggcaugggcgugaccuaccuggcccugcuggccgccuucaaggugagacccaccuucgccgccggccugcugcugagaaagcugaccagcaaggagcugaugaugaccaccaucggcaucgugcugcugagccagagcaccauccccgagaccauccuggagcugaccgacgcccuggcccugggcaugauggugcugaagaucgugagagacauggagaaguaccagcuggccgugaccaucauggccauccugugcgugcccaacgccgugauccugcagaacgccuggaaggugagcugcaccauccuggccguggugagcgugagcccccugcugcugaccagcagccagcagaagaccgacuggaucccccuggcccugaccaucaagggccugaaccccaccgccaucuuccugaccacccugagcagaaccaacaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccaccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggccuguuccccgugagcauccccaucaccgccgccgccugguaccugugggaggugaagaagcagagagccggcgugcugugggacgugcccagccccccccccaugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacaagggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucaucgacaagaagggcaagguggugggccuguacggcaacggcguggugaccagaagcggcgccuacgugagcgccaucgcccagaccgagaagagcaucgaggacaaccccgagaucgaggacgacaucuucagaaagagaagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucaucgacgaggagagagagauccccgagagaagcuggaacaccggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaagauggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaagaccagagacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcagaggcaucggcaagaugacccugggcaugugcugcaucaucaccgccagcgugcugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucgccacccagcagcccgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggaccccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccaccaacaccagaagaggcaccggcaacaucggcgagacccugggcgagaaguggaagagcagacugaacgcccugggcaagagcgaguuccagaccuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaucccccccgagaagugcgacacccugcugugcgacaucggcgagagcagccccaaccccaccguggaggccggcagaacccugagagugcugaaccugguggagaacuggcugaacaacaacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccagcggcaacaucgugagcagcgugaacaugaucagcagaaugcugaucaacagauucaccaugagacacaagaaggccaccuacgagcccgacguggaccugggcagcggcaccagaaacaucggcaucgagagcgagauccccaaccuggacaucaucggcaagagaaucgagaagaucaaggaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacgugcugcccaccgugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcagauucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacauggagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcguguucaagaacauccagcaccugaccgugaccgaggaggccgccgugcagaacuggcuggccagagugggcagagagagacugagcagaauggccaucagcggcgacgacugcguggugaagccccuggacgacagauucgccaacgcccugaccgcccugaacgacaugggcaagaucagaaaggacauccagcagugggagcccagcaagggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugagagagaccgccugccugggcaagagcuacgcccagauguggagccugauguacuuccacagaagagaccugagacuggccgccaacgccaucugcagcgccgugcccagccacugggugcccaccagcagaaccaccuggagcauccacgccaagcacgaguggaugaccaccgaggacaugcugaccguguggaacagaguguggaucagagagaaccccuggauggaggacaagacccccguggagagcugggaggagauccccuaccugggcaagagagaggaccaguggugcggcagccugaucggccugaccagcagagccaccugggccaagaacauccaggccgccaucaaccaggugagaagccugaucggcaacgaggaguacaccgacuacaugcccagcaugaagagauucagaagagaggaggaggaggccggcgugcugugguga

SEQ ID NO: 17678 - RNA, 9876 nt, Artificial Sequence
  derived and/or modified CDS sequence (opt4) from DENV-2__JF260983__SS-prME
accgccggcuuccugaucauggugauccccaccgugauggccuuccaccugaccaccagaaacggcgagccccacaugaucgugagcaagaacgagaagggcaagggccugcuguucaagaccgagaacggcaucaacaugugcacccugauggccauggaccugggcgagcugugcgaggacaccgugaccuacaagugccccuuccugaagcagaacgagcccgaggacaucgacugcuggugcaacagcaccagcaccugggugaccuacggcaccugcagcagcaccggcgagcacagaagagagaagagaagcguggcccuggugccccacgugggcaugggccuggagaccagaaccgagaccuggaugagcagcgagggcgccuggaagcaggcccagagaaucgagaccuggauccugagacaccccggcuucacccugauggccgccgugcuggccuacaccaucggcaccacccacuuccagagagcccugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguucugcaucgaggccaagcugaccaacaccaccaccgagagcagaugccccacccagggcgagcccagccugguggaggagcaggacaagagauucgugugcagacacagcaugguggacagaggcuggggcaacggcugcggccuguucggcaagggcggcaucgugaccugcgccauguucaccugccugaagaagauggagggcaagguggugcagcccgagaaccuggaguacaccaucgugaucaccccccacagcggcgaggagcacgccgugggcaacgacaccggcaagcacggcaaggaggugaagaucaccccccagagcagcaucagcgagaccgagcugaccgacuacggcaccaucaccauggagugcagccccagaaccggccuggacuucaacgagauggugcugcugcagauggagagcaaggccuggcuggugcacagacagugguuccuggaccugccccugcccuggcugcccggcgccgacacccagggcagcaacuggauccagaaggagaugcuggugaccuucaagaacccccacgccaagagacaggacgugguggugcugggcagccaggagggcgccaugcacaccgcccugaccggcgccaccgagauccagaugagccugggcaacauccuguucaugggccaccugaagugcagacugagaauggacaagcugcagcugaagggcaugagcuacagcaugugcaccggcaaguucaagguggugaaggagaucgccgagacccagcacggcaccaucgugaucagagugcaguacgagggcgacgacagccccugcaagauccccuucgagaucauggaccuggagaagaagcacgugcugggcagacugaucaccgugaaccccaucgugaccgagaaggacagccccaucaacaucgaggccgagccccccuucggcgacagcuacaucgugaucggcguggagcccggccagcugaagcugaacugguucaagaagggcagcagcaucggccagauguucgagaccaccaugagaggcgccaagagaauggccauccugggcgacaccgccugggacuucggcagcaucggcggcguguucaccagcgugggcaaggcccugcaccagguguucggcgccaucuacggcgccgccuucagcggcgugagcuggaccaugaagauccugaucggcguggugaucaccuggaucggcaugaacagcagaagcaccagccugagcgugacccuggugcuggugggcaucgugacccuguaccugggcgugauggugcaggccgacagcggcugcguggugagcuggaagaacaaggagcugaagugcggcagcggcaucuucgugaccgacaacgugcacaccuggaccgagcaguacaaguuccagcccgacagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgagaucaagggcaucaugcaggccggcagaagaagccugaagccccagcccaccgagcugagauacagcuggaagaccuggggcaaggccaaggugcugagcaccgagcugcagaaccagaccuuccugaucgacggccccgagaccaccgagugccccaacagcaacagagccuggaacagccuggagguggaggacuacggcuucggcaucuucaccaccaacaucuggcugaagcugagagagaagcaggacaugaucugcgacagcaagcugaugagcgccgccgugaaggacgacagagccgugcacgccgacaugggcuacuggaucgagagcagacugaacgacaccuggaagauggagaaggccagcuucaucgaggugaagagcugcuacuggcccagaagccacacccuguggagcaacggcgugcuggagagcgagaugaucauccccaagaaccuggccggccccgugagccagcacaacuacagacccggcuacuacacccagaccgccggccccuggcaccugggcaagcuggagauggacuucgaguucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagagagaggagaaccuggugaacagccuggugaccgccggccacggccagaucgacaacuucagccugggcauccugggcauggcccugcugcuggaggagaugcugagaaccagagugggcaccaagcacgcccugcugcugguggccaucagcuucgugacccugaucaccggcaacaugagcuucaaggaccugggcagagugaucaucauggugggcgccgccaugaccgacgagaugggcaugggcgugaccuaccuggcccugcuggccgccuucagagugagacccaccuucgccgugggccugcugcugagaaagcugaccagcaaggagcugcugauggccaccaucggcguggugcugcugagccagagcaacauccccggcaccgugcuggagcugaccgacgccaucgcccugggcaucauggugcugaagaucaugagaagcauggagaaguaccagcuggccgugaccgugauggccaugcugugcauccccaacgugaugauccugcagcacgccuggaaggugggcugcaccauccuggccgccgugagcgugagcccccugcugcugaccagcagccagcagaagaccgacuggaucccccuggcccugaccaucaagggccugaaccccaccgccaucuuccugaccacccugagcagacccagcaagaucagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagaaggccgccgaggugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggccuguuccccgugagcauccccaucaccgccgccgccugguaccugugggagaccaagaagcagagagccggcgugcugugggacgugcccagccccccccccaugggcaaggccgagcuggaggacggcgccuacagaaucaagcagagaggcaucuucggcuacagccagaucggcgccggcguguacaaggagggcaccuuccacaccauguggcacgugaccagaggcgccgugcuggugcacaagggcaagagacuggagcccagcugggccgacgugaagaaggaccugaucagcuacggcggcggcuggaagcuggagggcgaguggaaggacggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucaucgacagaaagggcaagguggugggccuguacggcaacggcguggugaccagaagcggcaccuacgugagcagcaucgcccagaccgagaagagcguggaggacaaccccgagaucgaggacgacaucuucagaaagaagagacugaccaucauggaccugcaccccggcgccggcaagaccaagagauaccugcccgccaucgugagagaggccaucagaagaggccugagaacccugauccuggcccccaccagagugguggccgccgagauggaggaggcccugagaggccugcccaucagauaccagacccccgccaucaaggccgagcacaccggcagagagaucguggaccugaugugccacgccaccuucaccaugagacugcugagccccaucagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgaguggaucaccaacuucaagggcaagaccgugugguucgugcccagcaucagagccggcaacgacaucgccgccugccugagaaagaacggcaagagagugauccagcugagcagaaagaccuucgacaccgaguacaccaagaccagaaccaacgacugggacuucguggugaccaccgacaucagcgagaugggcgccaacuucaaggccgagagagugaucgaccccagaagaugcaugaagcccgugauccugaccgacggcgaggagagaguggugcuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugaagagaggcgaccugcccguguggcuggccuacaagguggccagcgagggcaucaacuacgccgacagaaaguggugcuucgacggcaucagaaacaaccagauccuggaggagaacaucgagguggagguguggaccaaggagggcgagagaaagaagcugaagcccagauggcuggacgccagaaccuacagcgacccccuggcccugaaggaguucaaggaguucgccgccggcagaaagagccugacccugagccugaucaccgagaugggcagacugcccaccuucaugacccagaagaccagagacgcccuggacaaccuggccgugcugcacagcgccgagaugggcggcagagccuacaaccacgcccugagcgagcugcccgagacccuggagacccugcugcugcugggccugcuggccaccgugaccggcggcaucuuccuguuccugaugagcggcagaggcgugggcaagaugacccugggcaugugcugcaucaucaccgccagcggccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugacccugguggccgccaccauggccaacgagaugggcuuccuggagaagaccaagaaggaccugggccugggcggcuucaccaugcagcagcccgagaucaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggagcccauccccuacgaccccaaguucgagaagcagcugggccaggugaugcugcuggugcugugcgugacccaggugcugaugaugagaaccaccugggcccugugcgaggcccugacccuggccaccggccccaucagcacccugugggagggcaaccccggcaaguucuggaacaccaccaucgccgugagcauggccaacaucuucagaggcagcuaccuggccggcgccggccugcuguucagcaucaugagaaacaccaccagcgccagaagaggcaccggcaccaucggcgagacccugggcgagaaguggaagagcagacugaacgcccugggcagaagcgaguuccagaucuacaagaagagcggcauccaggagguggacagaacccuggccaaggagggcaucaagagaggcgagaccgaccaccacgccgugagcagaggcagcgccaagcugagaugguucguggagagaaacaugguggcccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagagaugcgacacccugcugugcgacaucggcgagagcagccccaaccccaccguggaggccggcagaacccugagagugcugaaccugguggagaacuggcugggcagcaacacccaguucugcaucaaggugcugaaccccuacaugcccagcgugaucgagagaauggagacccugcagagaaaguucggcggcgcccuggugagaaacccccugagcagaaacagcacccacgagauguacugggugagcaacgccagcggcaacaucgugagcagcgugaacaugaucagcagaaugcugaucaacagauucaccaugagacacaagaaggccaccuacgagcccgacguggaccugggcagcggcaccagaaacaucggcaucgagugcgagacccccaacauggacaucaucggcaagagaaucgagaagaucaagcaggagcacgaggccagcuggcacuacgaccaggaccaccccuacaagaccugggccuaccacggcagcuacgagaccaagcagaccggcagcgccagcagcauggugaacggcguggugagacugcugaccaagcccugggacgugauccccauggugacccagauggccaugaccgacaccacccccuucggccagcagagaguguucaaggagaagguggacaccagaacccaggagcccaaggagggcaccaagaagcugaugagaaucaccgccgaguggcuguggggcgagcugggcagaagaaagaagcccagaaucugcaccagagccgaguucugcaacaaggugagaagcaacgccgcccugggcgccguguucaccgacgagaacaaguggaagagcgccagagaggccguggaggacgagagauucugggagcugguggagaaggagagaaaccugcaccuggacggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagacaucagcagaaaggccggcggcgccauguacgccgacgacaccgccggcugggacaccagaaucaccagcgaggaccugaagaacgaggagaugaucaccgaccagauggagggcagacacaagaagcuggccgaggccaucuucagacugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggccuguucaagagcauccugcaccugaccccccaggaggagaccgccgugcacgccuggcuggugagagagggcagagagagacuggccagaauggccaucagcggcgacgacugcguggugaagccccuggacgacagauucgccagagcccugaccgcccugaacgacaugggcaaggugagaaaggacauccagcagugggagcccagcaagggcuggagcgacuggacccaggugcccuucugcagccaccacuuccacgagcugaucaugaaggacggcagaaagcugguggugcccugcagaaaccaggacgagcugaucggcagagccagaaucagccagggcgccggcuggagccugagagagaccgccugccugggcaagagcuacgcccagauguggagccugauguacuuccacagaagagaccugagacuggccgccaacgccaucugcagcgccgugcccagccacugggugcccaccagcagaaccaccuggagcauccacgccagccacgaguggaugaccaccgaggacaugcuggccguguggaacagaguguggauccaggacaaccccuggauggaggacaagacccccguggagagcugggaggacauccccuaccugggcaagagagaggaccaguggugcggcagccugaucggccugaccagcagagccaccugggccaagaacauccagaccgccaucaaccaggugagagcccugaucggcgaggaggaguacauggacuacaugcccagcaugaagagauucagaagcgaggaggaggagagcggcgugcugugguga

SEQ ID NO: 17679 - RNA, 9876 nt, Artificial Sequence
  derived and/or modified CDS sequence (opt4) from DENV-2__AF119661__SS-prME
accgugggcgugaucaucaugcugauccccaccgccauggccuuccaccugaccaccagaaacggcgagccccacaugaucgugggcagacaggagaagggcaagagccugcuguucaagaccgaggacggcgugaacaugugcacccugauggccaucgaccugggcgagcugugcgaggacaccaucaccuacaagugcccccugcugagacagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgcccagagaaucgagaccuggauccugagacaccccggcuucaucaucauggccgccauccuggccuacaccaucggcaccacccacuuccagagagcccugaucuucauccugcugaccgccguggcccccagcaugaccaugagaugcaucggcgugagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgugacccugagaaaguacugcaucaaggccaagcugaccaacaccaccaccgagagcagaugccccacccagggcgagcccagccugaacgaggagcaggacaagagauucgugugcaagcacagcaugguggacagaggcuggggcaacggcugcggccuguucggcaagggcggcaucgugaccugcgccaccuucaccugcaagaagaacauggagggcaagaucgugcagcccgagaaccuggaguacaccaucgugaucaccccccacagcggcgaggagcacgccgugggcaacgacaccggcaagcacggcaaggagaucaagaucaccccccagagcagcaucaccgaggccgagcugaccggcuacggcaccgugaccauggagugcagccccagaaccggccuggacuucaacgagauggugcugcugcagauggaggacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagaucgugaaggagaucgccgagacccagcacggcaccaucgugaucagagugcaguacgagggcgacggcagccccugcaagauccccuucgagaucauggaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugaacugggugaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcgugaucacccuguaccugggcgccauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagagccacaaccagaccuuccugaucgacggccccgagaccgccgagugccccaacaccaacagagccuggaacagccuggagguggaggacuacggcuucggcguguucaccaccaacaucuggcugaagcugagagagaagcaggacguguucugcgacagcaagcugaugagcgccgccaucaaggacaacagagccgugcacgccgacaugggcuacuggaucgagagcgcccugaacgacaccuggaagauggagaaggccagcuucaucgaggugaagagcugccacuggcccaagagccacacccuguggagcaacggcgugcuggagagcgagaugaucauccccaagagcuucgccggccccgugagccagcacaacuacagacccggcuacuacacccagaccgccggccccuggcaccugggcaagcuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagagccugguggacagccuggugaccgccggccacggccagaucgacaacuucagccugggcgugcugggcauggcccuguuccuggaggagaugcugagaaccagagugggcaccaagcacgccauccugcugguggccgugagcuucgugacccugaucaccggcaacaugagccugagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugauggccaccaucggcaucgcccugcugagccagagcaccauccccgagaccauccuggagcugaccgacgcccuggcccugggcaugauggugcugaagaucgugagaaacauggagaaguaccagcuggccgugaccaucauggccaucagcugcgugcccaacgccgugauccugcagaacgccuggaaggugagcugcaccauccuggccgccgugagcgugagcccccugcugcugaccagcagccagcagaaggccgacuggaucccccuggcccugaccaucaagggccugaaccccaccgccaucuuccugaccacccuggccagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccaccgacgugaagugggaggaccaggccgagaucagcggcagcagccccauccugagcaucaccaucagcgaggacggcagcaugagcaucaagaacgaggaggaggagcagacccugaccauccugaucagaaccggccugcuggugaucagcggccuguuccccgugagcauccccaucaccgccgccgccugguaccugugggaggugaagaagcagagagccggcgugcugugggacgugcccagccccccccccguggagaaggccgagcuggaggacggcgccuacagaaucaagcagaagggcauccugggcuacagccagaucggcaccggcguguacaaggagggcaccuuccacaccauguggcacgugaccagaggcgccgugcugaugcacagaggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucguggacagaaagggcaagguggugggccuguacggcaacggcguggugaccagaagcggcgccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccaacaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacagaguggccgccgagggcaucaacuacgccgacagaagauggugcuucgacggcgugaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagagacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcgugggcaagaugacccugggcaugugcugcaucaucaccgccagcauccugcugugguacgcccagauccagccccacuggaucgccgccagcaucauccuggaguucuuccugauggugcugcugauccccgagcccgagaagcagagaaccccccaggacaaccagcugaccuacguggugaucgccauccugaccgugguggccgccaccauggccaacgagaugggcuuccuggagaagaccaagaaggaccugggccugggcagcaucgccacccaggagcccgagagcaacauccuggacaucgaccugagacccgccagcgccuggacccuguacgccguggccaccaccuucgugacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggaccccauccccuacgaccccaaguucgagaagcagcugggccaggugaugcugcugauccugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucuucaucaugaagaacaccaccaacaccagaagaggcaccggcaacaucggcgagacccugggcgagaaguggaagagcagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaacauggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccaucgaggccggcagaacccugagagugcugagccugguggagaacuggcugaacaacgacacccaguucugcaucaaggugcugaaccccuacaugcccagcgugaucgagaagauggagacccugcagagaaaguacggcggcgcccuggugagaaacccccugagcagaaacagcacccacgagauguacugggugagcaacgccaccggcaacaucgugagcagcgugaacaugaucagcagaaugcugaucaacagauucaccaugaagcacaagaaggccaccuacgagcccgacguggaccugggcagcggcaccagaaacaucggcaucgagagcgagauccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacguggugcccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacaacagauucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacauggagggcgagcacaagaagcuggccgaggccaucuucaagcugaccuaccagaacaaggccgugagagugcagagacccacccccagaggcaccgugauggacaucaucagcagaagagaccagagaggcagcggccaggugggcaccuacggccugaacaccuucaccaacauggaggcccagcugaucagacagauggagggcgagggcaucuucaagagcauccagcaccugaccgugaccgaggagaucgccgugcagaacuggcuggccagagugggcagagagagacugagcagaauggccaucagcggcgacgacugcguggugaagccccuggacgacagauucgccagcgcccugaccgcccugaacgacaugggcaaggugagaaaggacauccagcagugggagcccagcagaggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugaaggagaccgccugccugggcaagagcuacgcccagauguggagccugauguacuuccacagaagagaccugagacuggccgccaacgccaucugcagcgccgugcccagccacugggugcccaccagcagaaccaccuggagcauccacgccaagcacgaguggaugaccaccgaggacaugcugaccguguggaacagaguguggauccaggagaaccccuggauggaggacaagacccccguggagagcugggaggaggugcccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 17680 - RNA, 9876 nt, Artificial Sequence
  derived and/or modified CDS sequence (opt4) from DENV-2__EU056810__SS-prME
accgccggcaucaucaucaugcugauccccaccgugauggccuuccaccugaccaccagaaacggcgagccccacaugaucgugagcagacaggagaagggcaagagccugcuguucaagaccgaggacggcgugaacaugugcacccugauggccauggaccugggcgagcugugcgaggacaccaucaccuacaacugcccccugcugagacagaacgagcccgaggacaucgacugcuggugcaacagcaccagcaccugggugaccuacggcaccugcaccgccaccggcgagcacagaagagagaagagaagcguggcccuggugccccacgugggcaugggccuggagaccagaaccgagaccuggaugagcagcgagggcgccuggaagcacgcccagagaaucgagaccuggauccugagacaccccggcuucaccaucauggccgccauccuggccuacaccaucggcaccaccuacuuccagagagugcugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgccagcagaugccccacccagggcgagcccagccugaacgaggagcaggacaagagauucgugugcaagcacagcaugguggacagaggcuggggcaacggcugcggccuguucggcaagggcggcaucgugaccugcgccauguucaccugcaagaagaacauggagggcaagguggugcagcccgagaaccuggaguacaccaucgugaucaccccccacagcggcgaggagaacgccgugggcaacgacaccggcaagcacggcaaggagaucaagaucaccccccagagcagcaucaccgaggccgagcugaccggcuacggcaccgugaccauggagugcagccccagaaccggccuggacuucaacgagauggugcugcugcagauggagaacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucguggugagagugcaguacgagggcgacggcagccccugcaagauccccuucgagaucauggaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugaacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcguggugaucaccuggaucggcaugaacagcagaagcaccagccugagcgugagccuggugcuggugggcguggugacccuguaccugggcgugauggugcaggccgacagcggcugcguggugagcuggaagaacaaggagcugaagugcggcagcggcaucuucgugaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaagaccuggggcaaggccaagaugcugagcaccgagcugcacaaccagaccuuccugaucgacggccccgagaccgccgagugccccaacaccaacagagccuggaacagccuggagguggaggacuacggcuucggcguguucaccaccaacaucuggcugaagcugaaggagagacaggacguguucugcgacagcaagcugaugagcgccgccaucaaggacaacagagccgugcacgccgacaugggcuacuggaucgagagcgcccugaacgacaccuggaagaucgagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcaagcuggagguggacuucaacuucugcgagggcaccaccgugguggugaccggcgacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugaugaccaccaucggcaucgugcugcugagccagagcaccauccccgagaccgugcuggagcugaccgacgcccuggcccugggcaugauggugcugaagaucgugagaaacauggagaaguaccagcuggccgugaccaucauggccauccugugcgugcccaacgccgugauccugcagaacgccuggaaggugagcugcaccauccuggccguggugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugagaugggaggaccaggccgagaucagcggcagcagccccauccugagcaucaccaucagcgaggacggcagcaugagcaucaagaacgaggaggaggagcagacccugaccauccugaucagaaccggccugcuggugaucagcggccuguuccccgugagcauccccaucaccgccgccgccugguaccugugggaggugaagaagcagagagccggcgugcugugggacgugcccagccccccccccgugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacaagggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucguggacaagaagggcaagguggugggccuguacggcaacggcguggugaccagaagcggcaccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccgugagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacaucaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacagaguggccgccgagggcaucaacuacgccgacagaagauggugcuucgacggcaucaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagaaacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggacuucggccugggcagcaucgccacccagcagcccgagagcaacauccuggacaucgaccugagacccgccagcgccuggacccuguacgccguggccaccaccuucaucacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggaccccauccccuacgaccccaaguucgagaagcagcugggccaggugaugcugcuggugcugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccgccaacaccagaagaggcaccggcaacaccggcgagacccugggcgagaaguggaagaacagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaaccuggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccaucgaggccggcagaacccugagagugcugaaccugguggagaacuggcugaacaacaacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccagcggcaacaucgugagcagcgugaacaugaucagcagaaugcugaucaacagauucaccaugagacacaagaaggccaccuacgagcccgacguggaccugggcagcggcaccagaaacaucggcaucgagagcgagacccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacgugauccccaccgugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcagauucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacauggagggcgagcacaagaagcuggccgaggccaucuucaagcugaccuaccagaacaagguggugagagugcagagacccacccccagaggcaccgugauggacaucaucagcagaagagaccagagaggcagcggccaggugggcaccuacggccugaacaccuucaccaacauggaggcccagcugaucagacagauggagggcgagggcguguucaagagcauccagcaccugaccgugaccgaggagaucaccgugaagaacuggcuggccagagugggcagagagagacugagcagaauggccaucagcggcgacgacugcguggugaagccccuggacgacagauucgccagcgcccugaccgcccugaacgacaugggcaaggugagaaaggacauccagcagugggagcccagcagaggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugagagagaccgccugccugggcaagagcuacgcccagauguggagccugauguacuuccacagaagagaccugagacuggccgccaacgccaucugcagcgccgugcccagccacugggugcccaccagcagaaccaccuggagcauccacgccagacacgaguggaugaccaccgaggacaugcugaccguguggaacagaguguggauccaggagaaccccuggauggaggacaagacccccguggagagcugggaggagauccccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 17681 - RNA, 9876 nt, Artificial Sequence
  derived and/or modified CDS sequence (opt4) from DENV-2__EU056811__SS-prME
accgccggcaugaucaucaugcugauccccaccgugauggccuuccaccugaccaccagaaacggcgagccccacaugaucgugagcagacaggagaagggcaagagccugcuguucaagaccaaggacggcaccaacaugugcacccugauggccauggaccugggcgagcugugcgaggacaccaucaccuacaagugccccuuccugaagcagaacgagcccgaggacaucgacugcuggugcaacagcaccagcaccugggugaccuacggcaccugcaccaccaccggcgagcacagaagagagaagagaagcguggcccuggugccccacgugggcaugggccuggagaccagaaccgagaccuggaugagcagcgagggcgccuggaagcacgcccagagaaucgagaccuggauccugagacaccccggcuucaccaucauggccgccauccuggccuacaccaucggcaccacccacuuccagagagugcugaucuucauccugcugaccgccaucgcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcagcccgccacccugagaaaguacugcaucgaggccaagcugaccaacaccaccaccgacagcagaugccccacccagggcgagcccacccugaacgaggagcaggacaagagauucgugugcaagcacagcaugguggacagaggcuggggcaacggcugcggccuguucggcaagggcggcaucgugaccugcgccauguucaccugcaagaagaacauggagggcaagaucgugcagcccgagaaccuggaguacaccguggugaucaccccccacagcggcgaggagcacgccgugggcaacgacaccggcaagcacggcaaggaggugaagaucaccccccagagcagcaucaccgaggccgagcugaccggcuacggcaccgugaccauggagugcagccccagaaccggccuggacuucaacgagauggugcugcugcagauggaggacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagaucgugaaggagaucgccgagacccagcacggcaccaucgugaucagagugcaguacgagggcgacggcagccccugcaagauccccuucgagaucauggaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcuggacugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcgugaucaucaccuggaucggcaugaacagcagaagcaccagccugagcgugagccuggugcuggugggcaucgugacccuguaccugggcgugauggugcaggccgacagcggcugcguggugagcuggaagaacaaggagcugaagugcggcagcggcaucuucgugaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucaccagcgagcugaaccacauccugagcgagaacgaggugaagcugaccaucaugaccggcgacaucaagggcaucaugcaggugggcaagagaagccugagaccccagcccaccgagcugagauacagcuggaagaccuggggcaaggccaagaugcugagcaccgagcugcacaaccagaccuuccugaucgacggccccgagaccgccgagugccccaacaccaacagagccuggaacagccuggagguggaggacuacggcuucggcguguucaccaccaacaucuggcugagacugagagagaagcaggacgccuucugcgacagcaagcugaugagcgccgccaucaaggacaacagagccgugcacgccgacaugggcuacuggaucgagagcgcccugaacgacaccuggaagaucgagaaggccagcuucaucgaggugaagagcugccacuggcccaagagccacacccuguggagcaacggcgugcuggagagcgagauggugauccccaagaacaucgccggccccgugagccagcacaacaacagacccggcuaccacacccagaccgccggccccuggcaccugggcaagcuggagauggacuucgacuucugcgagggcaccaccgugguggugaccgaggagugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugagcagccuggugaccgccggccacggccagaucgacaacuucagccugggcauccugggcauggcccuguuccuggaggagaugcugagaaccagagugggcaccaagcacgccauccugcugguggccgugagcuuccugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugaugaccaccaucggcaucgugcugcugagccagagcagcauccccgagaccauccuggagcugaccgacgcccuggcccugggcaugauggugcugaagauggugagaaacauggagaaguaccagcuggccgugaccaucauggccauccugugcgugcccaacgccgugauccugcagaacgccuggaaggugagcugcaccacccuggccguggugagcgugagcccccugcugcugaccagcagccagcagaaggccgacuggaucccccuggcccugaccaucaagggccugaaccccaccgccaucuuccugaccacccugaccagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccaccgacgugaagugggacgaccaggccgagaucagcggcagcagccccauccugagcaucaccaucagcgaggacggcagcaugagcaucaagaacgaggaggaggagcagacccugaccauccugaucagaaccggccugcuggugaucagcggccuguuccccgugagcauccccaucaccgccgccgccugguaccugugggaggugaagaagcagagagccggcgugcugugggacgugcccagccccccccccgugggcagagccgagcuggaggacggcgccuacagaaucaagcagaagggcauccugggcuacagccagaucggcgccggcguguacaaggagggcaccuuccacaccauguggcacgugaccagaggcgccgugcugaugcacaagggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucagaaccaacaccggcaccaucggcgccgugagccuggacuucagccccggcaccagcggcagccccaucguggacaagaagggcaagguggugggccuguacggcaacggcguggugaccagaggcggcgccuacgugagcgccaucgcccagaccgagaagggcaucgaggacaaccccgagaucgaggacgacaucuucagaaagagaagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccaucagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaagaccggcaacgacaucgccgccugccugagaaagaacggcaagagagugauccagcugagcagaaagaccuucgacagcgaguacgugaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagaaucggcagaaaccccagaaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacaagguggccgccgagggcaucaacuacgccgacagaagauggugcuucgacggcaccagaaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagagacgcccuggacaaccuggccgugcugcacaccgccgaggccggcggcaaggccuacaaccacgcccugagcgagcugcccgagacccuggagacccugcugcugcugacccugcuggccaccgugaccggcggcaucuuccuguuccugaugagcggcagaggcaucggcaagaugacccugggcaugugcugcaucaucaccgccagcauccugcugugguacgcccagauccagccccacuggaucgccgccagcaucauccuggaguucuuccugaucgugcugcugauccccgagcccgagaagcagagaaccccccaggacaaccagcugaccuacgugaucaucgccauccugaccgugguggccgccaccauggccaacgagaugggcuuccuggagaagaccaagaaggaccugggccugggccacaucgccacccagcagcccgagagcaacauccuggacaucgaccugagacccgccagcgccuggacccuguacgccguggccaccaccuucaucacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugaugcugguggcccacuacgccaucaucggccccggccugcaggccaaggccaccagagaggcccagaagagagccgccgccggcaucaugaagaaccccaccguggacggcaucaccgugaucgaccuggaccccauccccuacgaccccaaguucgagaagcagcugggccaggugaugcugcuggugcugugcgugacccaggugcugaugaugagaaccaccugggcccugugcgaggcccugacccuggccaccggccccgugagcacccugugggagggcaaccccggcagauucuggaacaccaccaucgccgugagcauggccaacaucuucagaggcagcuaccuggccggcgccggccugcuguucagcaucaugaagaacaccaccagcaccagaagaggcaccggcaacaugggcgagacccugggcgagaaguggaagaacagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaaccuggugacccccgagggcaaggugguggaccugggcugcggcagaggcggcuggagcuacuacugcggcggccugaagaacgugagagaggugaagggccugaccaagggcggccccggccacgaggagcccauccccaugagcaccuacggcuggaaccuggugagacugcagagcggcguggacguguucuucgugccccccgagaagugcgacacccugcugugcgacaucggcgagagcagccccaaccccaccguggaggccggcagaacccugagagugcugaaccugguggagaacuggcugaacaacaacacccaguucugcgugaaggugcugaaccccuacaugcccagcgugaucgagagaauggagacccugcagagaaaguacggcggcgcccuggugagaaacccccugagcagaaacagcacccacgagauguacugggugagcaacgccagcggcaacaucgugagcagcgugaacaugaucagcagaaugcugaucaacagauucaccaugagacacaagaaggccaccuacgagcccgacguggaccugggcagcggcaccagaaacaucggcaucgagagcgagacccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacgugauccccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccaagaaggugagaagcaacgccgcccugggcgccaucuucaccgacgagaacaaguggaagagcgccagagaggccguggaggacaacagauucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagaggugagcaagaaggagggcggcgccauguacgccgacgacaccgccggcugggacaccagaaucaccaucgaggaccugaagaacgaggagaugaucaccaaccacauggccggcgagcacaagaagcuggccgaggccaucuucaagcugaccuaccagaacaagguggugagagugcagagacccacccccagaggcaccgugauggacaucaucagcagaagagaccagagaggcagcggccagguggugaccuacggccugaacaccuucaccaacauggaggcccagcugaucagacagauggagggcgagggcguguucaagagcauccagcaccugaccgccagcgaggagaucgccgugcaggacuggcuggugagagugggcagagagagacugagcagaauggccaucagcggcgacgacugcguggugaagccccuggacgacagauucgccaaggcccugaccgcccugaacgacaugggcaaggugagaaaggacauccagcagugggagcccagcagaggcuggaacgacuggacccaggugcccuucugcagccaccacuuccacgagcugaucaugaaggacggcagaacccugguggugcccugcagaaaccaggacgagcugaucggcagagccagaaucagccagggcgccggcuggagccugagagagaccgccugccugggcaagagcuacgcccagauguggagccugauguacuuccacagaagagaccugagacuggccgccaacgccaucugcagcgccgugcccagccacugggugcccaccagcagaaccaccuggagcauccacgccagccacgaguggaugaccaccgaggacaugcugaccguguggaacagaguguggauccuggagaaccccuggauggaggacaagacccccguggagagcugggaggagauccccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 17682 - RNA, 9876 nt, Artificial Sequence
  derived and/or modified CDS sequence (opt4) from DENV-2__DQ645545__SS-prME
accgccggcgugaucaucaugaugauccccaccgugguggccuuccaccugaccaccagaaacggcgagccccacaugaucgugagcagacaggagaagggcaagagccugcuguucaagaccgagaacggcgugaacaugugcacccugauggccauggaccugggcgagcugugcgaggacaccaucaccuacaacugcccccugcugagacagaacgagcccgaggacaucgacugcuggugcaacagcaccagcaccugggugaccuacggcaccugcaccgccaccggcgagcacagaagagagaagagaagcguggcccuggugccccacgugggcaugggccuggagaccagaaccgagaccuggaugagcagccagggcgccuggaagcacgcccagagaaucgagaccugggugcugagacaccccggcuucaccaucauggccgccauccuggccuacaccaucggcaccaccuacuuccagagagugcugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcaccccgccacccugagaaaguacugcaucgaggccaagcugaccaacaccaccaccgccagcagaugccccacccagggcgagcccagccugaacgaggagcaggacaagagauucgugugcaagcacagcaugguggacagaggcuggggcaacggcugcggccuguucggcaagggcggcaucgugaccugcgccauguucaccugcaagaagaacauggagggcaagguggugcagcccgagaaccuggaguacaccaucgugaucaccccccacagcggcgaggagaacgccgugggcaacgacaccggcaagcacggcaaggagaucaaggugaccccccagagcagcaucaccgaggccgagcugaccggcuacggcaccgugaccauggagugcagccccagaaccggccuggacuucaacgagauggugcugcugcagauggaggacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucgugaucagagugcaguacgagggcgacggcagccccugcaagauccccuucgagaucauggaccuggagaagagacacgugcugggcagacugaucaccgugaaccccaucgugaccggcaaggacagccccgugaacaucgaggccgagccccccuucggcgacagcuacaucaucaucggcguggagcccggccagcugaagcugagcugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcguggugaucaccuggaucggcaugaacagcagaagcaccagccugagcgugagccuggugcuggugggcguggugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaaggccuggggcaaggccaagaugcugagcaccgagcugcacaaccacaccuuccugaucgacggccccgagaccgccgagugccccaacaccaacagagccuggaacagccuggagguggaggacuacggcuucggcguguucaccaccaacaucuggcugaagcugaaggagagacaggacguguucugcgacagcaagcugaugagcgccgccaucaaggacaacagagccgugcacgccgacaugggcuacuggaucgagagcgcccugaacgacaccuggaagaucgagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcaagcuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugaugaccaccaucggcaucgugcugcugagccagagcaccauccccgagaccauccuggagcugaccgacgcccuggcccugggcaugauggugcugaagaucgugagaaacauggagaaguaccagcuggccgugaccaucauggccauccugugcgugcccaacgccgugauccugcagaacgccuggaaggugagcugcaccauccuggccguggugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugagaugggaggagcaggccgagaucagcggcagcagccccauccugagcaucaccaucagcgaggacggcagcaugagcaucaagaacgaggaggaggagcagacccugaccauccugaucagaaccggccugcuggugaucagcggccuguuccccgugagcauccccaucaccgccgccgccugguaccugugggaggugaagaagcagagagccggcgugcugugggacgugcccagccccccccccgugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacaagggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucguggacaagaagggcaagguggugggccuguacggcaacggcguggugaccagaagcggcaccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccaucagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagagugggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacagaguggccgccgagggcaucaacuacgccgacagaagauggugcuucgacggcgugaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagaaacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcgugcugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggacuucggccugggcggcaucgccacccagcagcccgagagcaacauccuggacaucgaccugagacccgccagcgccuggacccuguacgccguggccaccaccuucaucacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggaccccauccccuacgaccccaaguucgagaagcagcugggccaggugaugcugcuggugcugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccgccaacaccagaagaggcaccggcaacaccggcgagacccugggcgagaaguggaagaacagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaaccuggugacccccgagggcaaggugauggaccugggcugcggcagaggcggcuggagcuacuacugcggcggccugaagaacgugaaggaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccguggaggccggcagaacccugagagugcugaaccugguggagaacuggcugaacaacaacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccagcggcaacaucgugagcagcgugaacaugaucagcagaaugcugaucaacagauucaccaugagacacaagaaggccaccuacgagcccgacguggaccugggcagcggcaccagaaacaucggcaucgagagcgagacccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacgugauccccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcggcuucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacauggagggcgagcacaagaagcuggccgaggccaucuucaagcugaccuaccagaacaagguggugagagugcagagacccacccccagaggcaccgugauggacaucaucagcagaagagaccagagaggcagcggccagguggugaccuacggccugaacaccuucaccaacauggaggcccagcugaucagacagauggagggcgagggcguguucaagagcauccagcagcugaccgccaccgaggagaucgccgugaagaacuggcuggccagagugggcagagagagacugagcagaauggccaucagcggcgacgacugcguggugaagccccuggacgacagauucgccagcgcccugaccgcccugaacgacaugggcaaggugagaaaggacauccagcagugggagcccagcagaggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugagagagaccgccugccugggcaagagcuacgcccagauguggagccugauguacuuccacagaagagaccugagacuggccgccaacgccaucugcagcgccgugcccagccacugggugcccaccagcagaaccaccuggagcauccacgccacccacgaguggaugaccaccgaggacaugcugaccguguggaacagaguguggauccaggagaaccccuggaucgaggacaagacccccguggagagcugggaggagauccccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 17683 - RNA, 9876 nt, Artificial Sequence
  derived and/or modified CDS sequence (opt4) from DENV-2__DQ645546__SS-prME
accgccggcgugaucaucaugaugauccccaccgugguggccuuccaccugaccaccagaaacggcgagccccacaugaucgugagcagacaggagaagggcaagagccugcuguucaagaccgagaacggcgugaacaugugcacccugauggccauggaccugggcgagcugugcgaggacaccaucaccuacaacugcccccugcugagacagaacgagcccgaggacaucgacugcuggugcaacagcaccagcaccugggugaccuacggcaccugcaccgccaccggcgagcacagaagagagaagagaagcguggcccuggugccccacgugggcaugggccuggagaccagaaccgagaccuggaugagcagcgagggcgccuggaagcacgcccagagaaucgagaccugggugcugagacaccccggcuucaccaucauggccgccauccuggccuacaccaucggcaccaccuacuuccagagagugcugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcaccccgccacccugagaaaguacugcaucgaggccaagcugaccaacaccaccaccgccagcagaugccccacccagggcgagcccagccugaacgaggagcaggacaagagauucgugugcaagcacagcaugguggacagaggcuggggcaacggcugcggccuguucggcaagggcggcaucgugaccugcgccauguucaccugcaagaagaacauggagggcaagguggugcagcccgagaaccuggaguacaccaucgugaucaccccccacagcggcgaggagaacgccgugggcaacgacaccggcaagcacggcaaggagaucaaggugaccccccagagcagcaucaccgaggccgagcugaccggcuacggcaccgugaccauggagugcagccccagaaccggccuggacuucaacgagauggugcugcugcagauggaggacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucgugaucagagugcaguacgagggcgacggcagccccugcaagauccccuucgagaucauggaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugagcugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcguggugaucaccuggaucggcaugaacagcagaagcaccagccugagcgugagccuggugcuggugggcguggugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaaggccuggggcaaggccaagaugcugagcaccgagcugcacaaccacaccuuccugaucgacggccccgagaccgccgagugccccaacaccaacagagccuggaacagccuggagguggaggacuacggcuucggcguguucaccaccaacaucuggcugaagcugaaggagagacaggacguguucugcgacagcaagcugaugagcgccgccaucaaggacaacagagccgugcacgccgacaugggcuacuggaucgagagcgcccugaacgacaccuggaagaucgagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcaagcuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaagcacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugaugaccaccaucggcaucgugcugcugagccagagcaccauccccgagaccauccuggagcugaccgacgcccuggcccugggcaugauggugcugaagaucgugagaaacauggagaaguaccagcuggccgugaccaucauggccauccugugcgugcccaacgccgugauccugcagaacgccuggaaggugagcugcaccauccuggccguggugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugagaugggaggagcaggccgagaucagcggcagcagccccauccugagcaucaccaucagcgaggacggcagcaugagcaucaagaacgaggaggaggagcagacccugaccauccugaucagaaccggccugcuggugaucagcggccuguuccccgugagcauccccaucaccgccgccgccugguaccugugggaggugaagaagcagagagccggcgugcugugggacgugcccagccccccccccgugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacaagggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucguggacaagaagggcaagguggugggccuguacggcaacggcguggugaccagaagcggcaccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccaucagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagagugggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacagaguggccgccgagggcaucaacuacgccgacagaagauggugcuucgacggcgugaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagaaacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcgugcugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggacuucggccugggcggcaucgccacccagcagcccgagagcaacauccuggacaucgaccugagacccgccagcgccuggacccuguacgccguggccaccaccuucaucacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggaccccauccccuacgaccccaaguucgagaagcagcugggccaggugaugcugcuggugcugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccgccaacaccagaagaggcaccggcaacaccggcgagacccugggcgagaaguggaagaacagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaaccuggugacccccgagggcaaggugauggaccugggcugcggcagaggcggcuggagcuacuacugcggcggccugaagaacgugaaggaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccguggaggccggcagaacccugagagugcugaaccugguggagaacuggcugaacaacaacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccagcggcaacaucgugagcagcgugaacaugaucagcagaaugcugaucaacagauucaccaugagacacaagaaggccaccuacgagcccgacguggaccugggcagcggcaccagaaacaucggcaucgagagcgagacccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacgugauccccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcggcuucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacauggagggcgagcacaagaagcuggccgaggccaucuucaagcugaccuaccagaacaagguggugagagugcagagacccacccccagaggcaccgugauggacaucaucagcagaagagaccagagaggcagcggccagguggugaccuacggccugaacaccuucaccaacauggaggcccagcugaucagacagauggagggcgagggcguguucaagagcauccagcagcugaccgccaccgaggagaucgccgugaagaacuggcuggccagagugggcagagagagacugagcagaauggccaucagcggcgacgacugcguggugaagccccuggacgacagauucgccagcgcccugaccgcccugaacgacaugggcaaggugagaaaggacauccagcagugggagcccagcagaggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugagagagaccgccugccugggcaagagcuacgcccagauguggagccugauguacuuccacagaagagaccugagacuggccgccaacgccaucugcagcgccgugcccagccacugggugcccaccagcagaaccaccuggagcauccacgccacccacgaguggaugaccaccgaggacaugcugaccguguggaacagaguguggauccaggagaaccccuggaucgaggacaagacccccguggagagcugggaggagauccccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga

SEQ ID NO: 17684 - RNA, 9876 nt, Artificial Sequence
  derived and/or modified CDS sequence (opt4) from DENV-2__DQ645547__SS-prME
accgccggcgugaucaucaugaugauccccaccgugguggccuuccaccugaccaccagaaacggcgagccccacaugaucgugagcagacaggagaagggcaagagccugcuguucaagaccgagaacggcgugaacaugugcacccugauggccauggaccugggcgagcugugcgaggacaccaucaccuacaacugcccccugcugagacagaacgagcccgaggacaucgacugcuggugcaacagcaccagcaccugggugaccuacggcaccugcaccgccaccggcgagcacagaagagagaagagaagcguggcccuggugccccacgugggcaugggccuggagaccagaaccgagaccuggaugagcagcgagggcgccuggaagcacgcccagagaaucgagaccugggugcugagacaccccggcuucaccaucauggccgccauccuggccuacaccaucggcaccaccuacuuccagagagugcugaucuucauccugcugaccgccguggcccccagcaugaccaugagaugcaucggcaucagcaacagagacuucguggagggcgugagcggcggcagcuggguggacaucgugcuggagcacggcagcugcgugaccaccauggccaagaacaagcccacccuggacuucgagcugaucaagaccgaggccaagcaccccgccacccugagaaaguacugcaucgaggccaagcugaccaacaccaccaccgccagcagaugccccacccagggcgagcccagccugaacgaggagcaggacaagagauucgugugcaagcacagcaugguggacagaggcuggggcaacggcugcggccuguucggcaagggcggcaucgugaccugcgccauguucaccugcaagaagaacauggagggcaagguggugcagcccgagaaccuggaguacaccaucgugaucaccccccacagcggcgaggagaacgccgugggcaacgacaccggcaagcacggcaaggagaucaaggugaccccccagagcagcaucaccgaggccgagcugaccggcuacggcaccgugaccauggagugcagccccagaaccggccuggacuucaacgagauggugcugcugcagauggaggacaaggccuggcuggugcacagacagugguuccuggaccugccccugcccuggcugcccggcgccgacacccagggcagcaacuggauccagaaggagacccuggugaccuucaagaacccccacgccaagaagcaggacgugguggugcugggcagccaggagggcgccaugcacaccgcccugaccggcgccaccgagauccagaugagcagcggcaaccugcuguucaccggccaccugaagugcagacugagaauggacaagcugcagcugaagggcaugagcuacagcaugugcaccggcaaguucaagguggugaaggagaucgccgagacccagcacggcaccaucgugaucagagugcaguacgagggcgacggcagccccugcaagauccccuucgagaucauggaccuggagaagagacacgugcugggcagacugaucaccgugaaccccaucgugaccgagaaggacagccccgugaacaucgaggccgagccccccuucggcgacagcuacaucaucaucggcguggagcccggccagcugaagcugagcugguucaagaagggcagcagcaucggccagauguucgagaccaccaugagaggcgccaagagaauggccauccugggcgacaccgccugggacuucggcagccugggcggcguguucaccagcaucggcaaggcccugcaccagguguucggcgccaucuacggcgccgccuucagcggcgugagcuggaccaugaagauccugaucggcguggugaucaccuggaucggcaugaacagcagaagcaccagccugagcgugagccuggugcuggugggcguggugacccuguaccugggcgugauggugcaggccgacagcggcugcguggugagcuggaagaacaaggagcugaagugcggcagcggcaucuucaucaccgacaacgugcacaccuggaccgagcaguacaaguuccagcccgagagccccagcaagcuggccagcgccauccagaaggcccacgaggagggcaucugcggcaucagaagcgugaccagacuggagaaccugauguggaagcagaucacccccgagcugaaccacauccugagcgagaacgaggugaagcugaccaucaugaccggcgacaucaagggcaucaugcaggccggcaagagaagccugagaccccagcccaccgagcugaaguacagcuggaaggccuggggcaaggccaagaugcugagcaccgagcugcacaaccacaccuuccugaucgacggccccgagaccgccgagugccccaacaccaacagagccuggaacagccuggagguggaggacuacggcuucggcguguucaccaccaacaucuggcugaagcugaaggagagacaggacguguucugcgacagcaagcugaugagcgccgccaucaaggacaacagagccgugcacgccgacaugggcuacuggaucgagagcgcccugaacgacaccuggaagaucgagaaggccagcuucaucgaggugaagagcugccacuggcccaagagccacacccuguggagcaacggcgugcuggagagcgagaugaucauccccaagaacuucgccggccccgugagccagcacaacuacagacccggcuaccacacccagaccgccggccccuggcaccugggcaagcuggagauggacuucgacuucugcgagggcaccaccgugguggugaccgaggacugcggcaacagaggccccagccugagaaccaccaccgccagcggcaagcugaucaccgaguggugcugcagaagcugcacccugcccccccugagauacagaggcgaggacggcugcugguacggcauggagaucagaccccugaaggagaaggaggagaaccuggugaacagccuggugaccgccggccacggccagaucgacaacuucagccugggcgugcugggcauggcccuguuccuggaggagaugcugagaaccagagugggcaccaaguacgccauccugcugguggccgugagcuucgugacccugaucaccggcaacaugagcuucagagaccugggcagagugauggugauggugggcgccaccaugaccgacgacaucggcaugggcgugaccuaccuggcccugcuggccgccuucaaggugagacccaccuucgccgccggccugcugcugagaaagcugaccagcaaggagcugaugaugaccaccaucggcaucgugcugcugagccagagcaccauccccgagaccauccuggagcugaccgacgcccuggcccugggcaugauggugcugaagaucgugagaaacauggagaaguaccagcuggccgugaccaucauggccauccugugcgugcccaacgccgugauccugcagaacgccuggaaggugagcugcaccauccuggccguggugagcgugagcccccugcugcugaccagcagccagcagaaggccgacuggaucccccuggcccugaccaucaagggccugaaccccaccgccaucuuccugaccacccugagcagaaccagcaagaagagaagcuggccccugaacgaggccaucauggccgugggcauggugagcauccuggccagcagccugcugaagaacgacauccccaugaccggcccccugguggccggcggccugcugaccgugugcuacgugcugaccggcagaagcgccgaccuggagcuggagagagccgccgacgugagaugggaggagcaggccgagaucagcggcagcagccccauccugagcaucaccaucagcgaggacggcagcaugagcaucaagaacgaggaggaggagcagacccugaccauccugaucagaaccggccugcuggugaucagcggccuguuccccgugagcauccccaucaccgccgccgccugguaccugugggaggugaagaagcagagagccggcgugcugugggacgugcccagccccccccccgugggcaaggccgagcuggaggacggcgccuacagaaucaagcagaagggcauccugggcuacagccagaucggcgccggcguguacaaggagggcaccuuccacaccauguggcacgugaccagaggcgccgugcugaugcacaagggcaagagaaucgagcccagcugggccgacgugaagaaggaccugaucagcuacggcggcggcuggaagcuggagggcgaguggaaggagggcgaggaggugcaggugcuggcccuggagcccggcaagaaccccagagccgugcagaccaagcccggccuguucaagaccaacaccggcaccaucggcgccgugagccuggacuucagccccggcaccagcggcagccccaucguggacaagaagggcaagguggugggccuguacggcaacggcguggugaccagaagcggcaccuacgugagcgccaucgcccagaccgagaagagcaucgaggacaaccccgagaucgaggacgacaucuucagaaagaagagacugaccaucauggaccugcaccccggcgccggcaagaccaagagauaccugcccgccaucgugagagaggccaucaagagaggccugagaacccugauccuggcccccaccagagugguggccgccgagauggaggaggcccugagaggccugcccaucagauaccagacccccgccaucagagccgagcacaccggcagagagaucguggaccugaugugccacgccaccuucaccaugagacugcugagccccaucagagugcccaacuacaaccugaucaucauggacgaggcccacuucaccgaccccgccagcaucgccgccagaggcuacaucagcaccagaguggagaugggcgaggccgccggcaucuucaugaccgccaccccccccggcagcagagaccccuucccccagagcaacgcccccaucauggacgaggagagagagauccccgagagaagcuggaacagcggccacgagugggugaccgacuucaagggcaagaccgugugguucgugcccagcaucaaggccggcaacgacaucgccgccugccugagaaagaacggcaagaaggugauccagcugagcagaaagaccuucgacagcgaguacgugaagaccagaaccaacgacugggacuucguggugaccaccgacaucagcgagaugggcgccaacuucaaggccgagagagugaucgaccccagaagaugcaugaagcccgugauccugaccgacggcgaggagagagugauccuggccggccccaugcccgugacccacagcagcgccgcccagagaagaggcagagugggcagaaaccccaagaacgagaacgaccaguacaucuacaugggcgagccccuggagaacgacgaggacugcgcccacuggaaggaggccaagaugcugcuggacaacaucaacacccccgagggcaucauccccagcauguucgagcccgagagagagaagguggacgccaucgacggcgaguacagacugagaggcgaggccagaaagaccuucguggaccugaugagaagaggcgaccugcccguguggcuggccuacagaguggccgccgagggcaucaacuacgccgacagaagauggugcuucgacggcgugaagaacaaccagauccuggaggagaacguggagguggagaucuggaccaaggagggcgagagaaagaagcugaagcccagauggcuggacgccagaaucuacagcgacccccuggcccugaaggaguucaaggaguucgccgccggcagaaagagccugacccugaaccugaucaccgagaugggcagacugcccaccuucaugacccagaaggccagaaacgcccuggacaaccuggccgugcugcacaccgccgaggccggcggcagagccuacaaccacgcccugagcgagcugcccgagacccuggagacccugcugcugcugacccugcuggccaccgugaccggcggcaucuuccuguuccugaugagcggcaagggcaucggcaagaugacccugggcaugugcugcaucaucaccgccagcgugcugcugugguacgcccagauccagccccacuggaucgccgccagcaucauccuggaguucuuccugaucgugcugcugauccccgagcccgagaagcagagaaccccccaggacaaccagcugaccuacguggugaucgccauccugaccgugguggccgccaccauggccaacgagaugggcuuccuggagaagaccaagaaggacuucggccugggcggcaucgccacccagcagcccgagagcaacauccuggacaucgaccugagacccgccagcgccuggacccuguacgccguggccaccaccuucaucacccccaugcugagacacagcaucgagaacagcagcgugaacgugagccugaccgccaucgccaaccaggccaccgugcugaugggccugggcaagggcuggccccugagcaagauggacaucggcgugccccugcuggccaucggcugcuacagccaggugaaccccaucacccugaccgccgcccugcugcugcugguggcccacuacgccaucaucggccccggccugcaggccaaggccaccagagaggcccagaagagagccgccgccggcaucaugaagaaccccaccguggacggcaucaccgugaucgaccuggaccccauccccuacgaccccaaguucgagaagcagcugggccaggugaugcugcuggugcugugcgugacccaggugcugaugaugagaaccaccugggcccugugcgaggcccugacccuggccaccggccccaucagcacccugugggagggcaaccccggcagauucuggaacaccaccaucgccgugagcauggccaacaucuucagaggcagcuaccuggccggcgccggccugcuguucagcaucaugaagaacaccgccaacaccagaagaggcaccggcaacaccggcgagacccugggcgagaaguggaagaacagacugaacgcccugggcaagagcgaguuccagaucuacaagaagagcggcauccaggagguggacagaacccuggccaaggagggcaucaagagaggcgagaccgaccaccacgccgugagcagaggcagcgccaagcugagaugguucguggagagaaaccuggugacccccgagggcaaggugauggaccugggcugcggcagaggcggcuggagcuacuacugcggcggccugaagaacgugaaggaggugaagggccugaccaagggcggccccggccacgaggagcccauccccaugagcaccuacggcuggaaccuggugagacugcagagcggcguggacguguucuucaccccccccgagaagugcgacacccugcugugcgacaucggcgagagcagccccaaccccaccguggaggccggcagaacccugagagugcugaaccugguggagaacuggcugaacaacaacacccaguucugcaucaaggugcugaaccccuacaugcccagcgugaucgagaagauggaggcccugcagagaaaguacggcggcgcccuggugagaaacccccugagcagaaacagcacccacgagauguacugggugagcaacgccagcggcaacaucgugagcagcgugaacaugaucagcagaaugcugaucaacagauucaccaugagacacaagaaggccaccuacgagcccgacguggaccugggcagcggcaccagaaacaucggcaucgagagcgagacccccaaccuggacaucaucggcaagagaaucgagaagaucaagcaggagcacgagaccagcuggcacuacgaccaggaccaccccuacaagaccugggccuaccacggcagcuacgagaccaagcagaccggcagcgccagcagcauggugaacggcguggugagacugcugaccaagcccugggacgugauccccauggugacccagauggccaugaccgacaccacccccuucggccagcagagaguguucaaggagaagguggacaccagaacccaggagcccaaggagggcaccaagaagcugaugaagaucaccgccgaguggcuguggaaggagcugggcaagaagaagacccccagaaugugcaccagagaggaguucaccagaaaggugagaagcaacgccgcccugggcgccaucuucaccgacgagaacaaguggaagagcgccagagaggccguggaggacagcggcuucugggagcugguggacaaggagagaaaccugcaccuggagggcaagugcgagaccugcguguacaacaugaugggcaagagagagaagaagcugggcgaguucggcaaggccaagggcagcagagccaucugguacauguggcugggcgccagauuccuggaguucgaggcccugggcuuccugaacgaggaccacugguucagcagagagaacagccugagcggcguggagggcgagggccugcacaagcugggcuacauccugagagacgugagcaagaaggagggcggcgccauguacgccgacgacaccgccggcugggacaccagaaucacccuggaggaccugaagaacgaggagauggugaccaaccacauggagggcgagcacaagaagcuggccgaggccaucuucaagcugaccuaccagaacaagguggugagagugcagagacccacccccagaggcaccgugauggacaucaucagcagaagagaccagagaggcagcggccagguggugaccuacggccugaacaccuucaccaacauggaggcccagcugaucagacagauggagggcgagggcguguucaagagcauccagcagcugaccgccaccgaggagaucgccgugaagaacuggcuggccagagugggcagagagagacugagcagaauggccaucagcggcgacgacugcguggugaagccccuggacgacagauucgccagcgcccugaccgcccugaacgacaugggcaaggugagaaaggacauccagcagugggagcccagcagaggcuggaacgacuggacccaggugcccuucugcagccaccacuuccacgagcugaucaugaaggacggcagagugcugguggugcccugcagaaaccaggacgagcugaucggcagagccagaaucagccagggcgccggcuggagccugagagagaccgccugccugggcaagagcuacgcccagauguggagccugauguacuuccacagaagagaccugagacuggccgccaacgccaucugcagcgccgugcccagccacugggugcccaccagcagaaccaccuggagcauccacgccacccacgaguggaugaccaccgaggacaugcugaccguguggaacagaguguggauccaggagaaccccuggaucgaggacaagacccccguggagagcugggaggagauccccuaccugggcaagagagaggaccaguggugcggcagccugaucggccugaccagcagagccaccugggccaagaacauccagaccgccaucaaccaggugagaagccugaucggcaacgaggaguacaccgacuacaugcccagcaugaagagauucagaagagaggaggaggaggccggcgugcugugguga
